United States Patent
Puzio et al.

(10) Patent No.: US 8,952,217 B2
(45) Date of Patent: Feb. 10, 2015

(54) PROCESS FOR DECREASING VERBASCOSE IN A PLANT BY EXPRESSION OF A CHLOROPLAST-TARGETED FIMD PROTEIN

(75) Inventors: Piotr Puzio, Berlin (DE); Birgit Wendel, Berlin (DE); Michael Manfred Herold, Berlin (DE); Ralf Looser, Berlin (DE); Astrid Blau, Stahnsdorf (DE); Gunnar Plesch, Potsdam (DE); Beate Kamlage, Berlin (DE); Florian Schauwecker, Berlin (DE)

(73) Assignee: Metanomics GmbH, Berlin (DE)

( * ) Notice: Subject to any disclaimer, the term of this patent is extended or adjusted under 35 U.S.C. 154(b) by 1219 days.

(21) Appl. No.: 11/516,230

(22) Filed: Sep. 6, 2006

(65) Prior Publication Data

US 2007/0118916 A1    May 24, 2007

(30) Foreign Application Priority Data

| Oct. 14, 2005 | (EP) | 05109592 |
| Nov. 7, 2005 | (EP) | 05110433 |
| Nov. 8, 2005 | (EP) | 05110441 |
| Nov. 17, 2005 | (EP) | 05111170 |
| Dec. 1, 2005 | (EP) | 05111910 |
| Dec. 12, 2005 | (EP) | 05112039 |
| Dec. 15, 2005 | (EP) | 05112431 |
| Dec. 22, 2005 | (EP) | 05113027 |
| Feb. 7, 2006 | (EP) | 06101589 |
| Feb. 14, 2006 | (EP) | 06110211 |
| Feb. 16, 2006 | (EP) | 06110005 |
| Feb. 17, 2006 | (EP) | 06110968 |
| Feb. 21, 2006 | (EP) | 06110215 |
| Feb. 22, 2006 | (EP) | 06110289 |
| Feb. 23, 2006 | (EP) | 06110325 |
| Feb. 23, 2006 | (EP) | 06110327 |
| Feb. 24, 2006 | (EP) | 06110367 |
| Feb. 24, 2006 | (EP) | 06110378 |
| Feb. 24, 2006 | (EP) | 06110383 |
| Feb. 24, 2006 | (EP) | 06110418 |
| Feb. 24, 2006 | (EP) | 06110423 |
| Feb. 24, 2006 | (EP) | 06110425 |
| Feb. 24, 2006 | (EP) | 06110426 |
| Feb. 24, 2006 | (EP) | 06110959 |
| Feb. 28, 2006 | (EP) | 06110579 |

(51) Int. Cl.

| C12N 15/82 | (2006.01) |
| C07H 21/04 | (2006.01) |
| A01H 5/00 | (2006.01) |
| C12P 7/64 | (2006.01) |
| C12P 13/06 | (2006.01) |
| C12P 13/10 | (2006.01) |
| C12P 13/12 | (2006.01) |

(52) U.S. Cl.
CPC ........ *C12N 15/8214* (2013.01); *C12N 15/8221* (2013.01); *C12N 15/8243* (2013.01); *C12N 15/8245* (2013.01); *C12N 15/8247* (2013.01); *C12N 15/825* (2013.01); *C12N 15/8251* (2013.01); *C12N 15/8253* (2013.01); *C12N 15/8254* (2013.01); *C12P 7/64* (2013.01); *C12P 13/06* (2013.01); *C12P 13/10* (2013.01); *C12P 13/12* (2013.01)
USPC .......... 800/288; 800/278; 800/295; 800/298; 536/23.7; 536/23.4; 435/320.1; 435/419; 435/468

(58) Field of Classification Search
None
See application file for complete search history.

(56) References Cited

U.S. PATENT DOCUMENTS

| 4,420,427 | A | 12/1983 | Hamunen et al. |
| 4,482,761 | A | 11/1984 | Chao et al. |
| 4,588,717 | A | 5/1986 | Mitchell |
| 4,652,527 | A | 3/1987 | Stirling |
| 4,734,402 | A | 3/1988 | Hashimoto et al. |
| 4,788,065 | A | 11/1988 | Nakamura et al. |
| 4,886,878 | A | 12/1989 | Larkins et al. |
| 4,962,028 | A | 10/1990 | Bedbrook et al. |
| 5,082,993 | A | 1/1992 | Strissel et al. |
| 5,096,594 | A | 3/1992 | Rabinowitz |
| 5,187,267 | A | 2/1993 | Comai et al. |
| 5,270,041 | A | 12/1993 | Eugster et al. |
| 5,296,364 | A | 3/1994 | Agrawal |
| 5,306,862 | A | 4/1994 | Chappell et al. |

(Continued)

FOREIGN PATENT DOCUMENTS

| CA | 2348888 A1 | 5/2000 |
| CA | 2379498 A1 | 8/2000 |

(Continued)

OTHER PUBLICATIONS

Blattner et al. Hypothetical outer membran usher protein. (2002) Accession B65113; pp. 1-2.*
Nishiyama et al. Identification anad characterization of the chaperone-subunit complex-binding domain from the type 1 pilus assembly platform FimD. (2003) JMB; vol. 330; pp. 513-525.*
Xu et al. Analysis of outer membrane proteome of *Escherichia coli* related to resistance to ampicillin and tetracycline. (2006) Proteomics; vol. 6; pp. 462-473.*

(Continued)

*Primary Examiner* — Cathy Kingdon Worley
(74) *Attorney, Agent, or Firm* — Drinker Biddle & Reath LLP

(57) ABSTRACT

The present invention relates to a process for decreasing verbascose in a plant by expression of a chloroplast-targeted polypeptide which is a member of the fimD superfamily in a plant cell, plant, or a part thereof. The invention furthermore relates to a process for producing a plant cell, plant, or part thereof with a decrease in the amount of verbascose. Also provided are nucleic acid constructs and vectors useful for practicing the methods as well as plants, plant tissues, propagation materials and harvested materials thus obtained. Agricultural compositions comprising the plant materials thus obtained is also provided.

22 Claims, 4 Drawing Sheets

(56) References Cited

U.S. PATENT DOCUMENTS

| | | |
|---|---|---|
| 5,349,126 A | 9/1994 | Chappell et al. |
| 5,352,605 A | 10/1994 | Fraley et al. |
| 5,354,672 A | 10/1994 | Fotheringham et al. |
| 5,365,017 A | 11/1994 | Chappell et al. |
| 5,455,818 A | 10/1995 | Ohashi et al. |
| 5,482,631 A | 1/1996 | Saska et al. |
| 5,502,045 A | 3/1996 | Miettinen et al. |
| 5,504,200 A | 4/1996 | Hall et al. |
| 5,523,087 A | 6/1996 | Shlyankevich |
| 5,530,149 A | 6/1996 | Scherkenbeck et al. |
| 5,565,350 A | 10/1996 | Kmiec |
| 5,589,616 A | 12/1996 | Hoffman |
| 5,589,619 A | 12/1996 | Chappell et al. |
| 5,591,616 A | 1/1997 | Hiei et al. |
| 5,608,152 A | 3/1997 | Kridl et al. |
| 5,641,814 A | 6/1997 | Martin |
| 5,670,635 A | 9/1997 | Datta et al. |
| 5,677,156 A | 10/1997 | Goto et al. |
| 5,677,474 A | 10/1997 | Rogers |
| 5,689,040 A | 11/1997 | Harada et al. |
| 5,693,507 A | 12/1997 | Daniell et al. |
| 5,747,464 A | 5/1998 | See |
| 5,767,366 A | 6/1998 | Sathasivan et al. |
| 5,892,068 A | 4/1999 | Higgins, III |
| 5,908,975 A | 6/1999 | Caimi et al. |
| 5,932,479 A | 8/1999 | Daniell et al. |
| 5,942,660 A | 8/1999 | Gruys et al. |
| 5,965,449 A | 10/1999 | Novak |
| 6,025,541 A | 2/2000 | Dietrich et al. |
| 6,043,411 A | 3/2000 | Nishizawa et al. |
| 6,051,250 A | 4/2000 | Ribier et al. |
| 6,054,261 A | 4/2000 | Masterson |
| 6,063,820 A | 5/2000 | Cavazza |
| 6,069,167 A | 5/2000 | Sokol |
| 6,080,788 A | 6/2000 | Sole et al. |
| 6,086,910 A | 7/2000 | Howard et al. |
| 6,087,124 A | 7/2000 | Steinbruck et al. |
| 6,087,353 A | 7/2000 | Stewart et al. |
| 6,099,854 A | 8/2000 | Howard et al. |
| 6,106,286 A | 8/2000 | Gupta |
| 6,107,281 A | 8/2000 | Jones et al. |
| 6,110,713 A | 8/2000 | Hanson et al. |
| 6,136,859 A | 10/2000 | Henriksen et al. |
| 6,150,130 A | 11/2000 | Misawa et al. |
| 6,153,582 A | 11/2000 | Skelnik |
| 6,159,476 A | 12/2000 | Djananov et al. |
| 6,159,508 A | 12/2000 | Wolf et al. |
| 6,162,419 A | 12/2000 | Perricone et al. |
| 6,166,077 A | 12/2000 | De Simone |
| 6,184,255 B1 | 2/2001 | Mae et al. |
| 6,191,172 B1 | 2/2001 | Borowy-Borowski et al. |
| 6,200,550 B1 | 3/2001 | Masterson et al. |
| 6,203,818 B1 | 3/2001 | Vester |
| 6,214,575 B1 | 4/2001 | Yano et al. |
| 6,218,436 B1 | 4/2001 | Howard et al. |
| 6,218,599 B1 | 4/2001 | Hirschberg et al. |
| 6,225,105 B1 | 5/2001 | Sathasivan et al. |
| 6,228,347 B1 | 5/2001 | Hersh |
| 6,228,402 B1 | 5/2001 | Wolf et al. |
| 6,228,891 B1 | 5/2001 | Enzmann et al. |
| 6,229,067 B1 | 5/2001 | Sonnewald et al. |
| 6,231,836 B1 | 5/2001 | Takhtalian et al. |
| 6,232,346 B1 | 5/2001 | Sole et al. |
| 6,232,530 B1 | 5/2001 | DellaPenna et al. |
| 6,242,491 B1 | 6/2001 | Kaddurah-Daouk |
| 6,245,378 B1 | 6/2001 | Cavazza |
| 6,245,800 B1 | 6/2001 | Arduini et al. |
| 6,248,363 B1 | 6/2001 | Patel et al. |
| 6,248,552 B1 | 6/2001 | Birkmayer |
| 6,254,547 B1 | 7/2001 | Phillips |
| 6,255,354 B1 | 7/2001 | Enzmann et al. |
| 6,258,847 B1 | 7/2001 | Chachoua |
| 6,258,848 B1 | 7/2001 | Fantus |
| 6,258,855 B1 | 7/2001 | Lorenz et al. |
| 6,261,250 B1 | 7/2001 | Phillips |
| 6,277,842 B1 | 8/2001 | Carthron |
| 6,294,697 B1 | 9/2001 | Wilbur et al. |
| 6,297,281 B1 | 10/2001 | Chabrier de Lassauniere et al. |
| 6,303,586 B1 | 10/2001 | McPeak et al. |
| 6,306,392 B1 | 10/2001 | Cavazza |
| 6,312,703 B1 | 11/2001 | Orthoefer |
| 6,328,987 B1 | 12/2001 | Marini |
| 6,329,432 B2 | 12/2001 | Howard et al. |
| 6,335,361 B1 | 1/2002 | Hamilton |
| 6,350,473 B1 | 2/2002 | Cheruvanky et al. |
| 6,355,295 B1 | 3/2002 | Altemueller et al. |
| 6,365,386 B1 | 4/2002 | Hoshino et al. |
| 6,368,617 B1 | 4/2002 | Hastings et al. |
| 6,380,252 B1 | 4/2002 | De Simone |
| 6,465,037 B1 | 10/2002 | Altemueller et al. |
| 6,610,840 B2 | 8/2003 | Sonnewald et al. |
| 6,645,404 B2 | 11/2003 | Oommen et al. |
| 6,652,866 B1 | 11/2003 | Hertha |
| 6,653,451 B1 | 11/2003 | Kerr et al. |
| 6,669,962 B2 | 12/2003 | Fanta et al. |
| 6,677,145 B2 | 1/2004 | Mukerji et al. |
| 6,723,837 B1 | 4/2004 | Karunanandaa et al. |
| 6,750,379 B2 | 6/2004 | McElroy et al. |
| 6,781,033 B2 | 8/2004 | Staub et al. |
| 6,887,708 B1 | 5/2005 | Coupland et al. |
| 7,060,876 B2 | 6/2006 | Hiei et al. |
| 7,220,899 B1 | 5/2007 | Reindl et al. |
| 7,297,847 B1 | 11/2007 | Ludevid et al. |
| 2002/0148006 A1 | 10/2002 | Nes |
| 2002/0156254 A1 | 10/2002 | Qiu et al. |
| 2003/0039672 A1 | 2/2003 | Ginger et al. |
| 2003/0040085 A1 | 2/2003 | Aoki et al. |
| 2003/0054509 A1 | 3/2003 | Lee et al. |
| 2003/0070192 A1 | 4/2003 | Keller et al. |
| 2003/0079255 A1 | 4/2003 | Qi et al. |
| 2003/0084479 A1 | 5/2003 | Herbers et al. |
| 2003/0092143 A1 | 5/2003 | Rabenhorst et al. |
| 2003/0101486 A1 | 5/2003 | Facciotti et al. |
| 2003/0143312 A1 | 7/2003 | Tamarkin et al. |
| 2003/0150008 A1 | 8/2003 | Karunanandaa et al. |
| 2004/0047971 A1 | 3/2004 | Alander |
| 2004/0053379 A1 | 3/2004 | Lerchl et al. |
| 2004/0067566 A1 | 4/2004 | Matsuda et al. |
| 2004/0097392 A1 | 5/2004 | Connor et al. |
| 2004/0101829 A1 | 5/2004 | Stapleton et al. |
| 2004/0128713 A1 | 7/2004 | Hitz et al. |
| 2004/0157290 A1 | 8/2004 | Lee et al. |
| 2004/0166130 A1 | 8/2004 | Filippi et al. |
| 2004/0172680 A1 | 9/2004 | Harker et al. |
| 2004/0172682 A1 | 9/2004 | Kinney et al. |
| 2004/0199940 A1 | 10/2004 | Karunanandaa et al. |
| 2005/0008713 A1 | 1/2005 | McAnalley et al. |
| 2005/0042737 A1 | 2/2005 | Vikso-Nielsen et al. |
| 2005/0054071 A1 | 3/2005 | Udagawa et al. |
| 2005/0055748 A1 | 3/2005 | Downie et al. |
| 2005/0069996 A1 | 3/2005 | Yajima et al. |
| 2005/0091716 A1 | 4/2005 | Chang et al. |
| 2005/0155100 A1 | 7/2005 | Blau et al. |
| 2006/0026704 A1 | 2/2006 | Selman-Housein Sosa et al. |

FOREIGN PATENT DOCUMENTS

| | | |
|---|---|---|
| DE | 229152 A1 | 10/1985 |
| DE | 3416853 A1 | 11/1985 |
| DE | 3416854 A1 | 11/1985 |
| DE | 271128 A1 | 8/1989 |
| DE | 273002 A1 | 11/1989 |
| DE | 293048 A5 | 8/1991 |
| DE | 294280 A5 | 9/1991 |
| DE | 19644478 A1 | 4/1998 |
| EP | 0195311 A2 | 9/1986 |
| EP | 0249676 A2 | 12/1987 |
| EP | 0271408 A2 | 6/1988 |
| EP | 0335528 A2 | 10/1989 |
| EP | 0375091 A1 | 6/1990 |
| EP | 0388186 A1 | 9/1990 |
| EP | 0550162 A1 | 7/1993 |
| EP | 0571741 A2 | 12/1993 |
| EP | 0672752 A1 | 9/1995 |

(56) References Cited

FOREIGN PATENT DOCUMENTS

| | | |
|---|---|---|
| EP | 0781849 A1 | 7/1997 |
| EP | 0794250 A1 | 9/1997 |
| EP | 1 577 396 A1 | 9/2005 |
| JP | 06062870 | 3/1894 |
| JP | 57129695 | 8/1982 |
| JP | 57202294 | 12/1982 |
| SU | 1406163 | 6/1988 |
| WO | WO-84/02913 A1 | 8/1984 |
| WO | WO 89/11789 A1 | 12/1989 |
| WO | WO-89/12386 A1 | 12/1989 |
| WO | WO-91/13972 A1 | 9/1991 |
| WO | WO-93/11245 A1 | 6/1993 |
| WO | WO-93/16187 A1 | 8/1993 |
| WO | WO-93/19190 A1 | 9/1993 |
| WO | WO-93/21334 A1 | 10/1993 |
| WO | WO-94/00977 A1 | 1/1994 |
| WO | WO-94/11516 A1 | 5/1994 |
| WO | WO-94/12015 A1 | 6/1994 |
| WO | WO-94/18337 A1 | 8/1994 |
| WO | WO-95/00634 A1 | 1/1995 |
| WO | WO-95/14098 A1 | 5/1995 |
| WO | WO-95/15389 A2 | 6/1995 |
| WO | WO-95/15392 A1 | 6/1995 |
| WO | WO-95/16783 A1 | 6/1995 |
| WO | WO-95/18222 A1 | 7/1995 |
| WO | WO-95/19443 A2 | 7/1995 |
| WO | WO-95/23230 A1 | 8/1995 |
| WO | WO-96/12814 A1 | 5/1996 |
| WO | WO-96/38574 A1 | 12/1996 |
| WO | WO-97/06250 A1 | 2/1997 |
| WO | WO-97/06268 A2 | 2/1997 |
| WO | WO-97/07665 A1 | 3/1997 |
| WO | WO-97/20944 A1 | 6/1997 |
| WO | WO-97/21340 A1 | 6/1997 |
| WO | WO-97/28247 A2 | 8/1997 |
| WO | WO-97/30582 A1 | 8/1997 |
| WO | WO-97/35999 A2 | 10/1997 |
| WO | WO-97/48793 A1 | 12/1997 |
| WO | WO 98/01572 A1 | 1/1998 |
| WO | WO-98/08962 A1 | 3/1998 |
| WO | WO-98/45457 A1 | 10/1998 |
| WO | WO-98/45461 A1 | 10/1998 |
| WO | WO-98/46763 A1 | 10/1998 |
| WO | WO-98/46764 A1 | 10/1998 |
| WO | WO-98/46765 A1 | 10/1998 |
| WO | WO-99/16890 A2 | 4/1999 |
| WO | WO-99/46394 A1 | 9/1999 |
| WO | WO-99/50430 A2 | 10/1999 |
| WO | WO-99/61652 A1 | 12/1999 |
| WO | WO-99/64616 A2 | 12/1999 |
| WO | WO-00/08190 A2 | 2/2000 |
| WO | WO-00/15815 A1 | 3/2000 |
| WO | WO-00/20602 A2 | 4/2000 |
| WO | WO-00/20603 A2 | 4/2000 |
| WO | WO-00/26388 A2 | 5/2000 |
| WO | WO-00/40705 A2 | 7/2000 |
| WO | WO-00/63391 A2 | 10/2000 |
| WO | WO-00/68393 A1 | 11/2000 |
| WO | WO-01/14572 A2 | 3/2001 |
| WO | WO-01/20009 A1 | 3/2001 |
| WO | WO-01/52620 A2 | 7/2001 |
| WO | WO-01/62781 A2 | 8/2001 |
| WO | WO 02/33060 A2 | 4/2002 |
| WO | WO-02/40682 A1 | 5/2002 |
| WO | WO-03/016551 A2 | 2/2003 |
| WO | WO-03/056024 A1 | 7/2003 |
| WO | WO-03/077642 A2 | 9/2003 |
| WO | WO-2004/004445 A2 | 1/2004 |
| WO | WO-2004/029256 A2 | 4/2004 |
| WO | WO-2004/040973 A2 | 5/2004 |
| WO | WO-2004/099425 A2 | 11/2004 |
| WO | WO-2005/123929 A2 | 12/2005 |

OTHER PUBLICATIONS

Peterbauer et al. Enzymatic control of the accumulation of verbascose in pea seeds. (2003) vol. 26; pp. 1385-1391.*

Wikipedia, "Raffinose" (2010) pp. 1-2.*

Klemm et al. The fimD gene required for cell surface localization of *Escherichia coli* type 1 fimbriae. (1990) Mol. Gen. Genet.; vol. 220; pp. 334-338.*

Lazar et al. Transforming growth factor alpha: mutation of aspartic acid 47 and leucine 48 results in different biological activities. (1988) Mol. Cell. Biol.; vol. 8; pp. 1247-1252.*

Hill et al. Functional analysis of conserved histidines in ADP-Glucose pyrophosphorylase from *Eschericia coli*. (1998) Biochem. Biophys. Res. Comm.; vol. 244; pp. 573-577.*

Guo et al. Protein tolerance to random amino acid changes. (2004) Proc. Natl. Acad. Sci. USA; vol. 101; pp. 9205-9210.*

An, G., "Binary Ti Plasmid Vectors", Methods in Molecular Biology, 1995, vol. 44, pp. 47-62.

Salmon, P. M., et al., "Fermenter Vent-Gas Analysis", Applied Microbial Physiology, Chapter 6, 1997, pp. 131-163.

Ison, A. P., et al., "Measurement of Biomass", Applied Microbial Physiology, Chapter 5, 1997, pp. 103-129.

Mousdale, D. M., "The Analytical Chemistry of Microbial Cultures", Applied Microbial Physiology, Chapter 7, 1997, pp. 165-192.

Greasham, R. L., "Design and Optimization of Growth Media", Applied Microbial Physiology, Chapter 3, 1997, pp. 53-73.

Greener, A., et al., "XL1-Red: A Highly Efficient Random Mutagenesis Strain", Strategies in Molecular Biology, 1994, vol. 7, pp. 32-34.

Miwa, T. K., "Jojoba Oil Wax Esters and Derived Fatty Acids and Alcohols: Gas Chromatographic Analyses", J Am Oil Chem Soc, 1971, vol. 48, pp. 259-264.

Christie, W. W., Advances on Lipid Methodology, 1997, Fourth Edition, Chapter 4, pp. 119-169.

"Sugar Fermentation Stimulation Protein—*Escherichia coli* (strain K-12)", PIR-PSD Database, Accession No. A43671, Mar. 3, 1993.

"Sequence 27 from Patent WO 97/31114", GenBank Database, Accession No. A64870, Mar. 29, 1999.

"CIT-HSP-2011F3.TFB", GenBank Database, Accession No. B64799, Nov. 21, 1997.

"CIT-HSP-2012F9.TRB", GenBank Database, Accession No. B64891, Nov. 21, 1997.

"CIT-HSP-2015C9.TRB" GenBank Database, Accession No. B65000, Nov. 21, 1997.

"C57987", GenBank Database, Accession No. C57987, Sep. 22, 1997.

"C64844", GenBank Database, Accession No. C64844, Sep. 22, 1997.

"CELK128D3R", GenBank Database, Accession No. D64949, Dec. 13, 1995.

"cDNA Sequence of Gene Perticipating in Induction of Resistivity Plant", GenBank Database, Accession No. E64990, Jun. 18, 2001.

"ycil Protein—*Escherichia coli* (strain K-12)", PIR-PSD Database, Entry No. F64872, Sep. 12, 1997.

"Hypothetical Protein b1980—*Escherichia coli* (strain K-12)", GenBank Database, Accession No. F64962, Sep. 12, 1997.

"FBN1-25 Random Genomic STS *Homo sapiens* STS Genomic, Sequence Tagged Site", GenBank Database, Accession No. G64969, Jun. 14, 2000.

"yu64e02.s1", GenBank Database, Accession No. H65105, Oct. 18, 1995.

"Glycosyltransferase—*Escherichia coli* (strain K-12)", PIR-PSD Database, Entry No. I69647, Jun. 7, 1996.

"Probable Molybdenum Transport Protein modF—*Escherichia coli* (strain K-12)", PIR-PSD Database, Entry No. JC6038, Sep. 10, 1999.

"Glycerol-3-phosphate Transport Protein—*Escherichia coli* (strain K-12)", PIR-PSD Database, Entry No. JNECGT, Jun. 30, 1991.

"Nicotinate Phosphoribosyltransferase (EC 2.4.2.11)—*Escherichia coli* (strain K-12)", PIR-PSD Database, Entry No. JQ0756, Sep. 10, 1999.

"Phosphoglycerate Kinase (EC 2.7.2.3)—Yeast (*Saccharomyce cerevisiae*)", PIR-PSD Database, Entry No. KIBYG, Jun. 13, 1983.

"Figwort Mosaic Virus Gene VI, complete cds", GenBank Database, Accession No. M59930, Aug. 2, 1993.

"Cdc19p [*Saccharomyces cerevisiae*]", GenBank Database, Accession No. NP_009362, Aug. 13, 2007.

(56) References Cited

OTHER PUBLICATIONS

"Alg3p [*Saccharomyces cerevisiae*]", GenBank Database, Accession No. NP_009471, Aug. 13, 2007.
"Nth2p [*Saccharomyces cerevisiaer*]", GenBank Database, Accession No. NP_009555, Aug. 13, 2007.
"3-deoxy-D-arabino-hepturosonate-7-phosphate (DAHP) synthase, catalyzes the first step in aromatic amino acid biosynthesis and is feedback-inhibited by phenylalanine or high concentration of tyrosine or tryptophan [*Saccharomyces cerevisiae*]", GenBank Database. Accession No. NP_010320, Aug. 13, 2007.
"Coq4p [*Saccharomyces cerevisiae*]", GenBank Database, Accession No. NP_010490, Aug. 13, 2007.
"Itr1p [*Saccharomyces cerevisiae*]", GenBank Database, Accession No. NP_010785, Aug. 13, 2007.
"Gly1p [*Saccharomyces cerevisiae*]", GenBank Database, Accession No. NP_010868, Aug. 13, 2007.
"Carnitine acetyltransferase; has similarity to Yat1p, which is a carntine acetyltransferase associated with the mitochondrial outer membrane [*Saccharomyces cerevisiae*].", GenBank Database, Accession No. NP_010941, Aug. 13, 2007.
"Protein required for inositol prototrophy, appears to be involved in the synthesis of inositol phospholipids from inositol but not in the control of inositol synthesis [*Saccharomces cerevisiae*].", GenBank Database, Accession No. NP_011389, Aug. 13, 2007.
Coq6p [*Saccharomyces cerevisiae*], GenBank Database, Accession No. NP_011771, Aug. 13, 2007.
"6-phosphogluconate dehydrogenase (decarboxylating), catalyzes an NADPH regenerating reaction in the pentose phosphate pathway; required for growth on D-glucono-delta-lactone [*Saccharomyces cerevisiae*].", GenBank Database, Accession No. NP_011772, Aug. 13, 2007.
"Mal11p [*Saccharomyces cerevisiae*]", GenBank Database, Accession No. NP_011805, Aug. 13, 2007.
"Delta-1-pyrroline-5-carboxylate dehydrogenase, nuclear-encoded mitochondrial protein involved in utilization of proline as sole nitrogen source; deficiency of the human homolog causes HPII, an autosomal recessive inborn error of metabolism [*Saccharomyces cerevisiae*]", GenBank Database, Accession No. NP_011902, Aug. 13, 2007.
Putative protein of unknown function; green fluorescent protein (GFP)-fusion protein localizes to the vacuole, while HA-tagged protein is found in the soluble fraction, suggesting cytoplasmic localization [*Saccharomyces cerevisiae*], GenBank Database, Accession No. NP_012072, Aug. 13, 2007.
"Putative protein of unknown function; green fluorescent protein (GFP)-fusion protein localizes to the cytoplasm and nucleus [*Saccharomyces cerevisiae*]", GenBank Database, Accession No. NP_012969, Aug. 13, 2007.
"Aat2p [*Saccharomyces cerevisiae*]", GenBank Database, Accession No. NP_013127, Aug. 13, 2007.
Ict1p [*Saccharomyces cerevisiae*], GenBank Database, Accession No. NP_013200, Aug. 13, 2007.
Acetyl-coA synthetase isoform which, along with Acs1p, is the nuclear source of acetyl-coA for histone acetylation; mutants affect global transcription; required for growth on glucose; expressed under anaerobic conditions [*Saccharomyces cerevisiae*], GenBank Database, Accession No. NP_013254, Aug. 13, 2007.
"Cytosolic NADP-specific isocitrate dehydrogenase, catalyzes oxidation of isocitrate to alpha-ketoglutarate; levels are elevated during growth on non-fermentable carbon sources and reduced during growth on glucose [*Saccharomyces cerevisiae*]", GenBank Database, Accession No. NP_013275, Aug. 13, 2007.
"Glucose-6-phosphate dehydrogenase (G6PD), catalyzes the first step of the pentose phosphate pathway; involved in adapting to oxidative stress; homolog of the human G6PD which is deficient in patients with hemolytic anemia [*Saccharomyces cerevisiae*]", GenBank Database, Accession No. NP_014158, Aug. 13, 2007.
"Uridine/cytidine kinase, component of the pyrimidine ribonucleotide salvage pathway that converts uridine into UMP and cytidine into CMP; invovled in the pyrimidine deoxyribonucleotide salvage pathway, converting deoxycytidine into dCMP [*Saccharomyces cerevisiae*]", GenBank Database, Accession No. NP_014409, Aug. 13, 2007.
"Key component of the RAM signaling network, required for proper cell morphogenesis and cell separation after mitosis [*Saccharomyces cerevisiae*]", GenBank Database, Accession No. NP_014998, Aug. 13, 2007.
"Spp1p [*Saccharomyces cerevisiae*]", GenBank Database, Accession No. NP_015187, Aug. 13, 2007.
"Gln1p [*Saccharomyces cerevisiae*]", GenBank Database, Accession No. NP_015360, Aug. 13, 2007.
"Conserved inner membrane protein [*Escherichia coli* K12]", GenBank Database, Accession No. NP_415021, May 1, 2007.
"Lipoate synthase [*Escherichia coli* K12]", GenBank Database, Accession No. NP_415161, May 1, 2007.
"Citrate synthase [*Escherichia coli* K12]", GenBank Database, Accession No. NP_415248, May 1, 2007.
"Putrescine transporter subunit: ATP-binding component of ABC superfamily [*Escherichia coli* K12]", GenBank Database, Accession No. NP_415376, May 1, 2007.
"3-oxoacyl-[acyl-carrier-protein] synthase II [*Escherichia coli* K12]", GenBank Database, Accession No. NP_415613, May 1, 2007.
"Adenylosuccinate lyase [*Escherichia coli* K12]", GenBank Database, Accession No. NP_415649, May 1, 2007.
"DNA polymerase V, subunit C [*Escherichia coli* K12]", GenBank Database. Accession No. NP_415702, May 1, 2007.
"Nitrate/Nitrite transporter [*Escherichia coli* K12]", GenBank Database, Accession No. NP_415741, May 1, 2007.
"Component I of anthranilate synthase [*Escherichia coli* K12]", GenBank Database, Accession No. NP_415780, May 1, 2007.
"Predicted hydrolase [*Escherichia coli* K12]", GenBank Database, Accession No. NP_415928, May 1, 2007.
"Qin prophage; predicted S lysis protein [*Escherichia coli* K12]", GenBank Database, Accession No. NP_416074, May 1, 2007.
"Fumarate hydratase (fumarase C), aerobic Class II [*Escherichia coli* K12]", GenBank Database Accession No. NP_416128, May 1, 2007.
"Predicted inner membrane subunit [*Escherichia coli* K12]", GenBank Database, Accession No. NP_416144, May 1, 2007.
"Conserved protein [*Escherichia coli* K12]", GenBank Database, Accession No. NP_416157, May 1, 2007.
"Predicted 4Fe—4S ferredoxin-type protein [*Escherichia coli* K12]", GenBank Database, Accession No. NP_416215, May 1, 2007.
"3-deoxy-D-arabino-heptulosonate-7-phosphate synthase, tryptophan repressible [*Escherichia coli* K12]", GenBank Database, Accession No. NP_416219, May 1, 2007.
"Predicted phosphatidyl transferase, inner membrane protein [*Escherichia coli* K12]", GenBank Database, Accession No. NP_416272, May 1, 2007.
"Glucose-6-phosphate dehydrogenase [*Escherichia coli* K12]", GenBank Database, Accession No. NP_416366, May 1, 2007.
"Tyrosine transporter [*Escherichia coli* K12]", GenBank Database, Accession No. NP_416420, May 1, 2007.
"Fused histidinol-phosphatase/imidazoleglycerol-phosphate dehydratase [*Escherichia coli* K12]", GenBank Database, Accession No. NP_416526, May 1, 2007.
"Imidazole glycerol phosphate synthase, catalytic subunit with HisH [*Escherichia coli* K12]", GenBank Database, Accession No. NP_416529, May 1, 2007.
"Uridine/cytidine kinase [*Escherichia coli* K12]", GenBank Database, Accession No. NP_416570, May 1, 2007.
"Lysine transporter [*Escherichia coli* K12]", GenBank Database, Accession No. NP_416661, May 1, 2007.
"Short chain fatty acid transporter [*Escherichia coli* K12]", GenBank Database, Accession No. NP_416727, May 1, 2007.
"Fused chorismate mutase T/prephenate dehydrogenase [*Escherichia coli* K12]", GenBank Database, Accession No. NP_417091, May 1, 2007.
"3-deoxy-D-arabino-heptulosonate-7-phosphate synthase, tyrosine-repressible [*Escherichia coli* K12]", GenBank Database, Accession No. NP_417092, May 1, 2007.

(56) References Cited

OTHER PUBLICATIONS

"Enolase [*Escherichia coli* K12]", GenBank Database, Accession No. NP_417259, May 1, 2007.
"N-acetylglutamate synthase [*Escherichia coli* K12]", GenBank Database, Accession No. NP_417295, Sep. 22, 2006.
"Phosphoglycerate kinase [*Escherichia coli* K12]", GenBank Database, Accession No. NP_417401, May 1, 2007.
"Ornithine decarboxylase, constitutive [*Escherichia coli* K12]", GenBank Database, Accession No. NP_417440, May 1, 2007.
"Glutamate synthase, 4Fe—4S protein, small subunit [*Escherichia coli* K12]", GenBank Database, Accession No. NP_417680, May 1, 2007.
"Dehydroshikimate reductase, NAD(P)-binding [*Escherichia coli* K12]", GenBank Database, Accession No. NP_417740, May 1, 2007.
"Glycogen synthase [*Escherichia coli* K12]", GenBank Database, Accession No. NP_417887, May 1, 2007.
"Hypothetical protein b3443 [*Escherichia coli* K12]", GenBank Database, Accession No. NP_417900, Sep. 22, 2006.
"Threonine 3-dehydrogenase, NAD(P)-binding [*Escherichia coli* K12]", GenBank Database, Accession No. NP_418073, May 1, 2007.
"Aspartate ammonia-lyase [*Escherichia coli* K12]", GenBank Database, Accession No. NP_418562, May 1, 2007.
"Hypothetical protein b1933—*Escherichia coli* strain K-12", GenBank Database, Accession No. B64957, Sep. 12, 1997.
"Seguenece 4 from Patent WO9413811", EMBL Database, Accession No. A39129, Mar. 5, 1997.
"GTP cyclohydrolase II (EC 3.5.4.25)—*Escherichia coli* (strain K-12]", PIR-PSD Database, Entry No. A40654, Sep. 10, 1999.
"Glucokinase (EC 2.7.1.2)—*Escherichia coli* (strain K-12)", PIR-PSD Database, Entry No. A65013, Sep. 12, 1997.
2-dehydro-3-deoxy-phosphoheptonate aldolase (EC 4.1.2.15) (Phe-sensitive)—*Escherichia coli* (strain K-12), PIR-PSD Database, Entry No. ADECHF, Aug. 18, 1982.
"F24G19TF" GenBank Database, Accession No. B28443, Oct. 10, 1997.
"HS-1059-B1-C04-MR.abi", Genbank Database, Accession No. B44511, Oct. 20, 1997.
"CIT-HSP-2012L3.TRB", GenBank Database, Accession No. B64910, Nov. 21, 1997.
"Hypothetical protein b1933—*Escherichia coli* (strain K-12)", GenBank Database, Accession No. B64957, Sep. 12, 1997.
"Phosphate-repressible phosphate-binding protein precursor [validated]—*Escherichia coli* (strain K-12)", PIR-PSD Database, Entry No. BYECPR, Mar. 31, 1989.
"1285761", GenBank Database, Accession No. C64769, Sep. 22, 1997.
"C64796", GenBank Database, Accession No. C64796, Sep. 22, 1997.
"C64847" GenBank Database, Accession No. C64847, Sep. 22, 1997.
"C64919", GenBank Database, Accession No. C64919, Sep. 22, 1997.
"Isocitrate dehydrogenase (NADP) (EC 1.1.1.42) [validated] *Escherichia coli* (strain K-12)", PIR-PSD Database, Entry No. DCECIS, Dec. 31, 1988.
"Orotidine-5'-phosphate decarboxylase (EC 4.1.1.23)—*Escherichia coli* (strain K-12)", PIR-PSD Database, Entry No. DCECOP, Dec. 31, 1988.
"Malate dehydrogenase (EC 1.1.1.37), cytosolic—yeast (*Saccharomyces cerevisiae*)", PIR-PSD Database, Entry No. DEBYMC, Jun. 30, 1993.
"Malate dehydrogenase (EC 1.1.1.37), peroxisomal—yeast (*Saccharomyces cerevisiae*)", PIR-PSD Database, Entry No. DEBYMP, Jun. 30, 1993.
"D-serine ammonia-lyase (EC 4.3.1.18)—*Escherichia coli* (strain K-12)", PIR-PSD Database, Entry No. DWECS, Nov. 30, 1980.
"Threonine ammonia-lyase (EC 4.3.1.19), blodegradative [validated]—*Escherichla coli* (strain K-12)", PIR-PSD Database, Entry No. DWECTD, Jun. 30, 1988.
"cDNA sequence of gene perticipating in induction of resistivity in plant", GenBank Database, Accession No. E64940, Jun. 18, 2001.
"cDNA sequence of gene perticipating in induction of resistivity in plant", GenBank Database, Accession No. E64980, Jun. 18, 2001.
"cDNA sequence of gene perticipating in induction of resistivity in plant", GenBank Database, Accession No. E65007, Jun. 18, 2001.
"FBNI-25 Random genomic STS *Homo sapiens* STS genomic, sequence tagged site.", GenBank Database, Accession No. G64969, Jun. 14, 2000.
"Hypothetical protein", DBGET Integrated Database, Entry No. pc1296, (2002).
"Hypothetical protein 200 (entA 3' region)—*Escherichia coli* (fragment)." GenBank Database, Accession No. Q0ECNA, Dec. 31, 1989.
"Lactaldehyde reductase (EC 1.1.1.77)—*Escherichia coli* (strain K-12)", PIR-PSD Database, Entry No. RDECLA, Jun. 30, 1990.
"L-arabinose transport ATP-binding protein araG—*Escherichia coli* (strain K-12)", PIR-PSD Database, Entry No. S01074, Jun. 30, 1989.
"4-hydroxybenzoate synthetase—*Escherichia coli* (strain K-12)", PIR-PSD Database, Entry No. S25660, Nov. 22, 1993.
"Glycolipid 2-alpha-mannosyltransferase (EC 2.4.1.131)—yeast (*Saccharomyces cerevisiae*)", PIR-PSD Database, Entry No. S36856, Dec. 31, 1993.
"Xylose transport permease protein xylH—*Escherchia coli* (strain K-12)", PIR-PSD Database, Entry No. S47789, Jan. 27, 1995.
"Hypothetical protein YMR262w—yeast (*Saccharomyces cerevisiae*)", PIR-PSD Database, Entry No. S54474, Jul. 8, 1995.
"ALG2 protein precursor—yeast (*Saccharomyces cerevisiae*)", PIR-PSD Database, Entry No. S64069, May 17, 1996.
"Hypothetical protein YDR430c—yeast (*Saccharomyces cerevisiae*)", PIR-PSD Database, Entry No. S69711, Aug. 22, 1996.
"Thymidyiate synthase (EC 2.1.1.45)—*Escherchia coli* (strain K-12)", PIR-PSD Database, Entry No. SYECT, Nov. 14, 1983.
"Tryptophanase (EC 4.1.99.1)—*Escherichia coli* (strain K12)", PIR-PSD Database, Entry WZEC, Nov. 14, 1983.
"Amidophosporibosyltransferase (EC 2.4.2.14) [validated]—*Escherichia coli* (strain K-12)", PIR-PSD Database, Entry No. XQEC, Aug. 18, 1982.
"Galactoside O-acetyltransferase (EC 2.3.1.18) [validated] *Escherichia coli* (strain K-12)", PIR-PSD Database, Entry No. XXECTG, Mar. 31, 1988.
"MNEI protein—yeast (*Saccaromyces cereviaiae*)", PIR-PSD Database, Entry No. S67259, Jul. 12, 1996.
"Q03886_YEAST" UniProtKB Database, Accession No. Q03886, Nov. 1, 1996.
"Carbon starvation protein A—*Escherichia coli* (strain K-12)", PIR-PSD Database, Entry No. Q0ECNA, Dec. 31, 1989.
"Hypothetical protein YHR204w yeast (*Saccharomyces cerevisiae*)", PIR-PSD Database, Entry No. S46693, Oct. 28, 1994.
"Xylose transport permease protein xylH—*Escherichia coli* (strain K-12)", PIR-PSD Database, Entry No. S47789, Jan. 27, 1997.
"Hypothetical 30.7K protein (secb-tdh intergenic region)—*Escherichia coli* (strain K-12)", PIR-PSD Database, Entry No. S47835, Jan. 27, 1995.
Hypothetical protein YER063w—yeast (*Saccharomyces cerevisiae*) PIR-PSD Database, Entry No. S50566, May 28, 1993.
"Acid phosphatase—*Escherichia coli* (strain K-12)", PIR-PSD Database, Entry No. S54790, Jul. 8, 1995.
"Orf3 . . . orf1 {avian adenovirus CELO, FAV1, Phelps, Genomic, 3 nt].", EMBL Database, Accession No. S61107, Feb. 9, 1994.
"Hypothetical protein YNL022c—yeast (*Saccharomyces cerevisiae*)", PIR-PSD Database, Entry No. S62934, Apr. 27, 1996.
"Probable membrane protein YGR262c—yeast (*Saccharomyces cerevisiae*)", PIR-PSD Database, Entry No. S64595, May 17, 1996.
"Hypothetical protein YLL033w—yeast (*Saccharomyces cerevisiae*)", PIR-PSD Database, Entry No. S64784, Aug. 1, 1995.
"Probable membrane protein YPL162c—yeast (*Saccharomyces cerevisiae*)", PIR-PSD Database, Entry No. S65173, Dec. 10, 1994.
"Glycine max nodule-specific phosphoribosylpyrophosphate amidotransferase (PRAT) gene, 5' upstream sequence and partial cds", GenBank Database, Accession No. U87999, Oct. 2, 1997.

(56) References Cited

OTHER PUBLICATIONS

"Figwort mosaic virus DNA for 34S promoter region", GenBank Database, Accession No. X16673, Sep. 9, 2004.
"Shikimate kinase I [*Escherichia coli* K12].", GenBank Database, Accession No. YP_026215, May 1, 2007.
"Branched-chain amino-acid aminotransferase [*Escherichia coli* K12]", GenBank Database, Accession No. YP_026247, May 1, 2007.
Worbs, M., et al., "Zur Gewinnung von Ubichinon-10 aus Acetobacter Methanolicus IMET B 346", Acta Biotechnol., 1986, vol. 6, No. 3, pp. 277-279.
Christie, W. W., "Gas Chromatography-Mass Spectrometry Methods for Structural Analysis of Fatty Acids", Lipids, 1998, vol. 33, No. 4, pp. 343-353.
Agatep, R., et al., "2 Hybrid System TRAFO Protocol", Technical Tips Online, 1998, pp. 1-5.
An, G., "Binary Ti Plasmid Vectors", Methods in Molecular Biology, vol. 44, pp. 47-62, (1995).
Alberts, B., et al., "The Cell-Division Cycle", Molecular Biology of the Cell, 1994, Chapter 17, pp. 863-910.
Anderson, N. L., "The Human *FA2H* Gene Encodes a Fatty Acid 2-Hydroxylase", The Journal of Biological Chemistry, 2004, vol. 279, No. 47, pp. 48562-48568.
Altschul, S. F., et al., "Gapped BLAST and PSI-BLAST: A New Generation of Protein Database Search Programs", Nucleic Acids Research, 1997, vol. 25, No. 17, pp. 3389-3402.
Amann, E., et al., "Tightly Regulated *tao* Promoter Vectors Useful for the Expression of Unfused and Fused Proteins in *Escherichia coli*", Gene, 1988, vol. 69, pp. 301-315.
Amrhein, N., et al., "The Site of the Inhinition of the Shikimate Pathway by Glyphosate", Plant Physiol., 1980, vol. 66, pp. 830-834.
Anderson, S. L., et al., "Light-Activated Heterotrpohic Growth of the Cyanobasterium *Synechocystis* sp. Strain PCC 6803: a Blue-Light-Requiring Process", Journal of Bacteriology, 1991, vol. 173, No. 9, pp. 2761-2767.
Kimura, Y., "Carp Oil or Oleic Acid, but Not Linoleic Acid or Linolenic Acid, Inhibits Tumor Growth and Metastasis in Lewis Lung Carcinoma-Bearing Mice", The Journal of Nutrition, 2002, vol. 132, pp. 2069-2075.
Herrmann, K. M., et al., "The Shikimate Pathway", Annu. Rev. Plant Physiol. Plant Mol. Biol., 1999, vol. 50, pp. 473-503.
Salmon, P. M., et al., "Fermenter Vent-Gas Analysis", Applied Microbial Physiology, Chapter 6, pp. 131-163, (1997).
Ison, A. P., et al., "Measurement of Biomass", Applied Microbial Physiology, Chapter 5, pp. 103-129, (1997).
Mousdale, D. M., "The Analytical Chemistry of Microbial Cultures", Applied Microbial Physiology, Chapter 7, pp. 165-192, (1997).
Greasham, R. L., "Design and Optimization of Growth Media", Applied Microbial Physiology, Chpater 3, pp. 53-73, (1997).
Jenes, B., et al., "Gene Transfer and Genetic Transformation", Transgenic Plants, 1993, vol. 1, pp. 125-143.
Babic, V., et al., "Development of an Efficient *Agrobacterium*-mediated Transformation System for *Brassica carinate*", Plant Cell Reports, 1998, vol. 17, pp. 183-188.
Bäumlein, H., et al., "*Cis*-analysis of a Seed Protein Gene Promoter: The Conservative RY Repeat CATGCATG within the Legumin Box is Essential for Tissue-Specific Expression of a Legumin Gene", The Plant Journal, 1992, vol. 2 No. 2, pp. 233-239.
Bäumlein, H., et al., "A Novel Seed Protein Gene from *Vicia faba* is Developementally Reguaalted in Transgenic Tobacco and *Arabidopsis* plants", Mol Gen Genet, 1991, vol. 225, pp. 459-467.
Baldari, C., et al., "A Novel Leader Peptide which Allows Efficient Secretion of a Fragment of Human Interleukin 1β in *Saccharomyces cerevisiae*", The EMBO Journal, 1987, vol. 6, No. 1, pp. 229-234.
Banerjee, A., et al., "Omega Amino Acids in Peptide Design: Incorporation into Helices", Biopolymers, 1996, vol. 39, pp. 769-777.
Bao, X., et al., "Supply of Fatty Acid is One Limiting Factor in the Accumulation of Triacylglycerol in Developing Embryos", Plant Physiology, 1999, vol. 120, pp. 1057-1062.

Barker, W. C., et al., "The PIR-International Protein Sequence Database", Nucleic Acids Research, 1999, vol. 27, No. 1, pp. 39-43.
Bauwe, H., et al., "Genetic Manipulation of Glycine Decarboxylation", Journal of Experimental Botany, 2003, vol. 54, No. 387, pp. 1523-1535.
Bechtold, N., et al., "In Planta *Agrobacterium* Mediated Gene Transfer by Infiltration of adult *Arabidopsis thaliana* Plants", C.R. Acad. Sci. Paris, 1993, vol. 316, pp. 1194-1199.
Becker, D., et al., "New Plant Binary Vectors with Selectable Markers Located Proximal to the Left T-DNA Border", Plant Molecular Biology, 1992, vol. 20, pp. 1195-1197.
Beharka, A. et al., "Vitamin E Status and Immune Function", Methods in Enzymology, 1997, vol. 282, pp. 247-263.
Benfey, P. N., et al., "The CaMV 35S Enhancer Contains at Least Two Domains which can Confer Different Developmental and Tissue-Specific Expression Patterns", The EMBO Journal, 1989, vol. 8, No. 8, pp. 2195-2202.
Benkirane N., et al., "Exploration of Requirements for Peptidomimetic Immune Recognition", The Journal of Biological Chemistry, 1996, vol. 271, No. 52, pp. 33218-33224.
Benson, D. A., et al., "GenBank", Nucleic Acids Research, 2000, vol. 28, No. 1, pp. 15-18.
Berks, A. H., "Patent Information in Biotechnology", TIBTECH, 1994, vol. 12, pp. 352-364.
Berry, A., et al., "A Prototype Computer System for De Novo Protein Design", Biochem. Soc. Trans., 1994, vol. 22, pp. 1033-1036.
Bevan, M., "Binary *Agrobacterium* Vectors for Plant Transformation", 1984, vol. 12, No. 22, pp. 8711-8721.
Okuyama, H., et al., "The *Cis/Trans* Isomerization of the Double Bond of a Fatty Acid as a Strategy for Adaptation to Changes in Ambient Temperature in the Psychrophilic Bacterium, *Vibrio* sp. Strain ABE-1", Biochimica et Biophysica Acta, 1991, vol. 1084, pp. 13-20.
Tani, Y., "Algal and Microbial Production of Vitamin E", Biotechnology of Vitamins, Pigments and Growth Factors, 1989, Chapter 6, pp. 95-104.
Bishop, D. K., et al., "Repair of Heteroduplex Plasmid DNA after Transformation into *Saccharomyces cerevisiae*", Molecular and Cellular Biology, 1986, vol. 6, No. 10, pp. 3401-3409.
Björkhem, I., et al., "Inborn Errors in Bile Acid Biosynthesis and Storage of Sterols Other than Cholesterol", The Metabolic and Molecular Bases of Inherited Disease, 2001, Chapter 123, pp. 2961-2988.
Blattner, F. R., et al., "The Complete Genome Sequence of *Escherichia coli* K-12", Science, 1997, vol. 277, pp. 1453-1474.
Block, K. P., "Interactions Among Leucine, Isoleucine, and Valine with Special Reference to the Branched-Chain Amino Acid Antagonism, Absorption and Utilization of Amino Acids", 1989, vol. 1, Chapter 11, pp. 229-244.
Bouhours, J-F., "Micro-Scale Seperation of Normal and Hydroxy Fatty Acid Methyl Esters on a Florisil Column", Journal of Chromatography, 1979, vol. 169, pp. 462-465.
Bouvier-Navé, P., et al., "Two Families of Sterol Methyltransferases are Involved in the First and the Second Methylation Steps of Plant Sterol Biosynthesis", Eur. J. Biochem., 1998, vol. 256, pp. 88-96.
Bowman, S., et al., "The Nucleotide Sequence of *Saccharomyces cerevisiae* chromosome XIII", Nature, 1997, vol. 387, pp. 90-93.
Broun, P., et al., "WIN1, a Transcriptional Activator of Epidermal Wax Accumulation in *Arabidopsis*", PNAS, 2004, vol. 101, No. 13, pp. 4706-4711.
Brown. D. C. W.. et al.. "Role of Genetic Background in Somatic Embryogenesis in *Medicago*", Plant Cell Tissue Organ Culture, 1985, vol. 4, pp. 111-122.
Browse, J., et al., "Fatty Acid Composition of Leaf Lipids Determined after Combined Digestion and Fatty Acid Methyl Ester Formation from Fresh Tissue", Analytical Biochemistry, 1986, vol. 152, pp. 141-145.
Burri, B. J., "Carotenoids and Gene Expression", Nutrition, 2000, vol. 16, No. 7/8, pp. 577-578.
Bussey, H., et al., "The Nucleotide Sequence of *Saccharomyces cerevisiae* Chromosome XVI", Nature, 1997, vol. 387, pp. 103-105.
Bussey, H., et al., "The Nucleotide Sequence of Chromosome I from *Saccharomyces cerevisiae*", PNAS, 1995, vol. 92, pp. 3809-3813.

(56) References Cited

OTHER PUBLICATIONS

Cahoon, E. B., et al., "Biosynthetic Origin of Conjugated Double Bonds: Production of Fatty Acid Components of High-Value Drying Oils in Transgenic Soybean Embryos", PNAS, 1999, vol. 96, No. 22, pp. 12935-12940.

Cataldi, T. R. I., et al., "Determination of Sugar Compounds in Olive Plant Extracts by Anion-Exchange Chromatography with Pulsed Amperometric Detection", Anal. Chem., 2000, vol. 72, pp. 3902-3907.

Palanivelu, R., et al., "Pollen Tube Growth and Guidance is Regulated by POP2, an *Arabidopsis* Gene that Controls GABA Levels", Cell, 2003, vol. 114, pp. 47-59.

Chang, S. S., et al., "Stable Genetic Transformation of *Arabidopsis thaliana* by *Agrobacterium* Inoculation In Planta", The Plant Journal, 1994, vol. 5, No. 4, pp. 551-558.

Chang, A. C. Y., et al., "Construction and Characterization of Amplifiable Multicopy DNA Cloning Vehicles Derived from the P15A Cryptic Miniplasmid", Journal of Bacteriology, 1978, vol. 134, No. 3, pp. 1141-1156.

Chen, J. H., et al., "Pinelloside, an Antimicrobial Cerebroside from *Pinellia ternata*", Phytochemistry, 2003, vol. 64, pp. 903-906.

Cherry, J. M., et al,, "SGD: *Saccharomyces* Genome Database", Nucleic Acids Research, 1998, vol. 26, No. 1, pp. 73-79.

Chirgwin, J. M., et al., "Isolation of Biologically Active Ribonucleic Acid from Sources Enriched in Ribonuclease", Biochemistry, 1979, vol. 18, No. 24, pp. 5294-5299.

Churin, Y. N., et al., "Physical and Genetic Map of the Chromosome of the Unicellular Cyanobacterium *Synechocystis* sp. Strain PCC 6803.", Journal of Bacteriology, 1995, vol. 177, No. 11, pp. 3337-3343.

Clough, S. J., et al., "Floral Dip: A Simplified Method for *Agrobacterium*-Mediated Transformation of *Arabidopsis thaliana*", The Plant Journal, 1998, vol. 16, No. 6, pp. 735-743.

Cohen, Z., et al., "Production and Partial Purification of γ-Linolenic Acid and Some Pigments from *Spirulina platensis*", Journal of Applied Phycology, 1993, vol. 5, pp. 109-115.

Colbert, T., et al., "High-Throughput Screening for Induced Point Mutations", Plant Physiology, 2001, vol. 126, pp. 480-484.

Comai, L., et al., "Novel and Useful Properties of a Chimeric Plant Promoter combining CaMV 35S and MAS Elements", Plant Molecular Biology, 1990, vol. 15, pp. 373-381.

Corio-Costet, M. F., et al., "Metabolism of Dietary Δ$^8$-Sterols and 9β, 19-Cyclopropyl Sterols by *Locusta migratoria*", Archives of Insect Biochemistry and Physiology, 1989, vol. 11, pp. 47-62.

Costet, M. F., et al., "Ecdysteroid Biosynthesis and Embryonic Development are Disturbed in Insects (*Locusta migratoria*) Reared on Plant Diet (*Triticum sativum*) with a Selectivity Modified Sterol Profile", Proc. Natl. Acad. Sci. USA, 1987, vol. 84, pp. 643-647.

Champ, P. C., et al., "Amino Acids: Metabolism of Carbon Atoms", Lippincott Illustrated Reviews: Biochemistry, 1987, Chapter 21, pp. 239-253.

Howitt. C. A.. "Amplification of DNA from Whole Cells of Cyanobacteria Using PCR". BioTechniques, 1996, vol. 21, No. 1, pp. 32-34.

"Hybridization with Radioactive Probes", Current Protocols in Molecular Biology, 1989, pp. 6.3.1-6.3.6.

De Castro Silva Filho, M., et al., "Mitochondrial and Chloroplast targeting sequences in Tandem Modify Protein Import Specificity in Plant Organelles", Plant Molecular Biology, 1996, vol. 30, pp. 769-780.

De Cosa, B., et al., "Overexpression of the *Bt cry2*Aa2 Operon in Chloroplasts Leads to Formation of Insecticidal Crystals", Nature Biotechnology, 2001, vol. 19, pp. 71-74.

de Vries, J. H. M., et al., "The Fatty Acid and Sterol Content of Food Composites of Middle-Aged Men in Seven Countries", Journal of Food Composition and Analysis, 1997, vol. 10, pp. 115-141.

Delgado-Vargas, F., et al., "Natural Pigments: Carotenoids, Anthocyanins, and Betalains—Characteristics, Biosynthesis, Processing, and Stability", Critical Reviews in Food Science and Nutrition, 2000, vol. 40, No. 3, pp. 173-289.

Deli, J., et al., "Paprika Carotenoids: Analysis, Isolation. Structure Elucidation", Current Organic Chemistry, 2002, vol. 6, pp. 1197-1219.

Della-Cioppa, G., et al., "Protein Trafficking in Plant Cells", Plant Physiol., 1987, vol. 84, pp. 965-968.

Delorme, E., "Transformation of *Saccharomyces cerevisiae* by Electroporation", Applied and Environmental Microbiology, 1989, Vo. 55, No. 9, pp. 2242-2246.

Eggersdorfer, M., et al., "Vitamins", Ullmann's Encyclopedia of Industrial Chemistry, Fifth Completely Revised Edition, 1996, vol. A27, pp. 443-613.

Dietrich, F. S., et al., "The Nucleotide Sequence of *Saccharomyces cerevisiae* Chromosome V", Nature, 1997, vol. 387, pp. 78-81.

Dörmann, P., et al., "Galactolipids Rule in Seed Plants", Trends in Plant Science, 2002, vol. 7, No. 3, pp. 112-118.

Dufourmantel, N., et al., "Generation of Fertile Transplastomic Soybean", Plant Molecular Biology, 2004, vol. 55, pp. 479-489.

Dujon, B., et al., "Complete DNA Sequence of Yeast Chromosome XI", Nature, 1994, vol. 369, pp. 371-378.

Dujon, B., et al., "The Nucleotide Sequence of *Saccharomyces cerevisiao* Chromosome XV", Nature, 1997, vol. 387, pp. 98-102.

Ghoshal, D., et al., "Chloroplastic Glyceride Isoform of Dihydroxyacetone Phosphate Reductase from *Dunaliella tertiolecta*: Purification and Characterization", J. Plant Biochemistry & Biotechnology, 2001, vol. 10, pp. 113-120.

Eastmond, P. J., "Glycerol-Insensitive *Arabidopsis* Mutants: *gli1* Seedlings Lack Glycerol Kinase, Accumulate Glycerol and are More Resistant to Abiotic Stress", The Plant Journal, 2004, vol. 37, pp. 617-625.

White, F. F., "Vectors for Gene Transfer in Higher Plants", Transgenic Plants, 1993, vol. 1, pp. 15-38.

Jenes, B., et al., "Techniques for Gene Transfer", Transgenic Plants, 1993, vol. 1, pp. 125-143.

Falciatore, A., et al,, "Transformation of Nonselectable Reporter Genes in Marine Diatoms", Mar. Biotechnol., 1999, vol. 1, pp. 239-251.

Fallon, A., et al., "Application of HPLC in Biochemistry: The Theory of HPLC", Laboratory Techniques in Biochemistry and Molecular Biology, 1987, vol. 17, Chapter 2, pp. 8-21.

Fallon, A., et al., "Application of HPLC in Biochemistry: Lipids", Laboratory Techniques in Biochemistry and Molecular Biology, 1987, vol. 17, Chapter 11.3 pp. 193-207.

Fassina, G., et al.. "Identification of Interactive Sites of Proteins and Protein Receptors by Computer-Assisted Searches for Complementary Peptide Sequences", Immunomethods, 1994, vol. 5, pp. 114-120.

Seidel, V. H., et al., "Möglichkeiten zur Gewinnung von Ubichinonen aus Methylotrophen Bakterienbiomassen", Fat Sci. Technol., 1992, vol. 94, No. 4, pp. 153-157.

Feldmann, K. A., et al., "*Agrobacterium*-Mediated Transformation of Germinating Seeds of *Arabidopsis thaliana* A Non-Tissue Culture Approach", Mon Gen Genet, 1987, vol. 208, pp. 1-9.

Feldmann, H., et al., "Complete DNA Sequence of Yeast Chromosome II", The EMBO Journal, 1994, vol. 13, No. 24, pp. 5795-5809.

Feldmann, K. A., "T-DNA Insertion Mutagenesis in *Arabidopsis*: Seed Infection/Transformation", Methods in *Arabidopsis* Research, 1992, Chapter 10, pp. 274-289.

Miura, Y., et al., "Production of γ-Linolenic Acid from the Marine Green Alga *Chlorella* sp. NKG 042401", FEMS Microbiology Letter, 1993, vol. 107, pp. 163-168.

Ferrando, A. A., et al., "Oral Branched-Chain Amino Acids Decrease Whole-Body Proteolysis", Journal of Parenteral and Enternal Nutrition, 1995, vol. 19, No. 1, pp. 47-54.

Fiehn, O., et al., "Metabolite Profiling for Plant Functional Genomics", Nature Biotechnology, 2000, vol. 18, pp. 1157-1161.

Fleischmann, R. D., et al., "Whole-Genome Random Sequencing and Assembly of *Haemophilus influenzae* Rd", Science, 1995, vol. 269, pp. 496-512.

Flores, R., "A Naked Plant-Specific RNA Ten-Fold Smaller than the Smallest know Viral RNA: the Viroid", Life Sciences, 2001, vol. 324, pp. 943-952.

(56) References Cited

OTHER PUBLICATIONS

Foreman, P. K., et al., "The *Saccharomyces cerevisiae* RPB4 Gene is Tightly Linked to the TIF2 Gene", Nucleic Acids Research, 1991 vol. 19, No. 10, p. 2781.

Franck, A., et al., "Nucleotide Sequence of Cauliflower Mosaic Virus DNA", Cell, 1980, vol. 21, pp. 285-294.

Fraser, H. B., et al., "Evolutionary Rate in the Protein Interaction Network", Science, 2002, vol. 296, pp. 750-752.

Fraser, P. D., et al., "Application of High-Performance Liquid Chromatography with Photodiode Array Detection to the Metabolic Profiling of Plant Isoprenoids", The Plant Journal, 2000, vol. 24, No. 4, pp. 551-558.

Freedman, J. A , et al , "Genetic Requirements for Spontaneous and Transcription-Stimulated Mitotic Recombination in *Saccharomyces cerevisiae*", Genetics, 2002, vol. 162, pp. 15-27.

Fromm, H., et al., "An Octopine Synthase Enhancer Element Directs Tissue-Specific Expression and Binds ASF-1, a Factor from Tobacco Nuclear Extracts", The Plant Cell, 1989, vol. 1, pp. 977-984.

Galfré, G., et al., "Preparation of Monoclonal Antibodies: Strategies and Procedures", Methods in Enzymology, 1981, vol. 73, pp. 3-46.

Galili, S., et al., "Enhanced Levels of Free and Protein-Bound Threonine in Transgenic alfalfa (*Medicagb sativa* L.) Expressing a Bacterial FeedBack-Insensitive Aspartate Kinase Gene", Transgenic Research, 2000, vol. 9, pp. 137-144.

Gallie, D. R., et al., "A Comparison of Eukaryotic Viral 5'-Leader Sequences as Enhancers of mRNA Expression in vivo", Nucleic Acids Research, 1987, vol. 15, No. 21, pp. 8693-8711.

Gatz, C., "Chemical Control of Gene Expression", Annu. Rev. Plant Physiol. Plant Mol. Biol., 1997, vol. 48, pp. 89-108.

Gatz, C., et al., "Stringent Repression and Homogeneous De-Repression by Tetracycline of a Modified CaMV 35S Promoter in Intact Transgenic Tobacco Plants", The Plant Journal, 1992, vol. 2, No. 3, pp. 397-404.

Christie, W. W., "Structural Analysis of Fatty Acids", Advances in Lipid Methodology—Four, 1997, Chapter 4, pp. 119-169.

Geigenberger, P., et al., "Phloem-Specific Expression of Pyrophosphatase Inhibits Long-Distance Transport of Carbohydrates and Amino Acids in Tobacco Plant", Plant, Cell and Environment, 1996, vol. 19, pp. 43-55.

Ghirardi, M. I.., et al., "Oxygen Sensitivity of Algal $H_2$-Production", Applied Biochemistry and Biotechnology, 1997, vol. 63-65, pp. 141-151.

Semin, B. K., et al., "Accumulation of Ferrous Iron in *Chlamydomonas reinhardtii*, Influence of $CO_2$ and Anaerobic Induction of the Reversible Hydrogenase", Plant Physiology, 2003, vol. 131, pp. 1756-1764.

Ghoshal, D., et al., "Osmoregulatory Isoform of Dihydroxyacetone Phosphate Reductase from *Dunaliella tertiolecta*: Purification and Characterization", Protein Expression and Purification, 2002, vol. 24, pp. 404-411.

Gibbs, J. B., et al., "Pharmaceutical Research in Molecular Oncology", Cell, 1994, vol. 79, pp. 193-198.

Gibson, T. J., et al., "Lorist6, a Cosmid Vector with *Bam*HI, *Not*I, *Sca*I and *Hin*dIII Cloning Sites and Altered Neomycin Phosphotransferase Gene Expression", Gene, 1987, vol. 53, pp. 283-286.

Gielen, J., et al, "The Complete Nucleotide Sequence of the TL-DNA of the *Agrobacterium tumefaciens* Plasmid pTiAch5", The EMBO Journal, 1984, vol. 3, No. 4, pp. 835-846.

Gietz, R. D., et al., "Transforming Yeast with DNA", Methods in Molecular and Cellular Biology, 1995, vol. 5, pp. 255-269.

Goffeau, A., et al., "Life with 6000 Genes", Science, 1996, vol. 274, pp. 546-547.

Golds, T., et al., "Stable Plastid Transformation in PEG-Treated Protoplasts of *Nicotiana tabacum*", Bio/Technology, 1993, vol. 11, pp. 95-97.

Greener, A., et al., "An Efficient Random Mutagenesis Technique Using an *E. coli* Mutator Strain", Methods in Molecular Biology, 1996, vol. 57, Chapter 34, pp. 375-385.

Greener, A., et al., "XL1-Red: A Highly Efficient Random Mutagenesis Strain", Strategies in Molecular Biology, vol. 7, pp. 32-34, (1994).

Gruber, M. Y., et al., "Vectors for Plant Transformation", Methods in Plant Molecular Biology and Biotechnology, 1993, Chapter 7, pp. 89-108.

Guan, X., et al., "Heritable Endogenous gene Regulation in Plants with Designed Polydactyl Zinc Finger Transcription Factors", PNAS, 2002, vol. 99, No. 20, pp. 13296-13301.

Hesse, H., et al., "Molecular Aspects of Methionine Biosynthesis", Trends in Plant Science, 2003, vol. 8, No. 6, pp. 259-262.

Ernst, H., "Recent Advances in Industrial Carotenoid Synthesis", Pure Appl. Chem., 2002, vol. 74, No. 8, pp. 1369-1382.

Hargrove, J. L., et al., "Nutritional Significance and Metabolism of Very Long Chain Fatty Alcohols and Acids from Dietary Waxes", The Society for Experimental Biology and Medicine, 2004, vol. 229, No. 3, pp. 215-226.

Härtel, H., et al., "DGD1-Independent Biosynthesis of Extraplastidic Galactolipids After Phosphate Deprivation in *Arabidopsis*", PNAS, 2000, vol. 97, No. 19, pp. 10649-10654.

Hayashi, H., et al., "Activation of a Plant Gene by T-DNA Tagging: Auxin-Independent Growth In Vitro", Science, 1992, vol. 258, pp. 1350-1353.

Heijne, G. V., et al., "CHLPEP—A Database of Chloroplast Transit Peptides", Plant Molecular Biology Reporter, 1991, vol. 9, No. 2, pp. 104-126.

Hellens, R., et al., "A Guide to *Agrobacterium* Binary Ti Vectors", Trends in Plant Science, 2000, vol. 5, No. 10, pp. 446-451.

Hendriks, H. F. J., et al., "Spreads Enriched with Three Different Levels of Vegetable Oil Sterols and the Degree of Cholesterol Lowering in Chormocholesterolaemic and Mildly Hypercholesterolaemic Subjects", European Journal of Clinical Nutrition, 1999, vol. 53, pp. 319-327.

Higgins, D. G., et al., "Fast and Sensitive Multiple Sequence Alignments on Microcomputer on a Microcomputer", CABIOS Communications, 1989, vol. 5, No. 2, pp. 151-153.

Hinton, A., et al., "Use of Oleic Acid to Reduce the Population of the Bacterial Flora of Poultry Skin", Journal of Food Protection, 2000, vol. 63, No. 9, pp. 1282-1286.

Hoffman, C. S., et al., "Glucose Repression of Transcription of the *Schizosaccharomyces pombe fbp1* Gene Occurs by a cAMP Signaling Pathway", Genes & Development, 1991, vol. 5, pp. 561-571.

Hoffman, D. L., et al., "Rapid Protein Structure Classification using One-Dimensional Structure Profiles on the BioSCAN Parallel Computer", CABIOS, 1995, vol. 11, No. 6, pp. 675-679.

Höfgen, R., et al., "Storage of Competent Cells for *Agrobacterium* Transformation", Nucleic Acids Research, 1988, vol. 16, No. 20, p. 9877.

Hood, E. E., et al., "Plant-Based Production of Xenogenic Proteins", Current Opinion in Biotechnology, 1999, vol. 10, pp. 382-386.

Hoshi, M., et al., "Synthesis of Cerebronic Acid from Lignoceric Acid by Rat Brain Preparation", The Journal of Biological Chemistry, 1973, vol. 248, No. 11, pp. 4123-4130.

Hou, B-K., et al., "Chloroplast Transformation in Oilseed Rape", Transgenic Research, 2003, vol. 12, pp. 111-114.

Huala, E., et al., "The *Arabidopsis* Information Resource (TAIR): A Comprehensive Database and Web-Based Information Retrieval, Analysis, and Visualization System for a Model Plant", Nucleic Acids Research 2001, vol. 29, No. 1, pp. 102-105.

Huang, Y-S., et al., "Cloning of Δ12- and Δ6-Desaturases from *Mortierella alpina* and Recombinant Production of γ-Linolenic Acid in *Saccharomyces cerevisiae*", Lipids, 1999, vol. 34, No. 7, pp. 649-659.

Hupp, T. R., et al., "small Peptides Activate the Latent Sequence-Specific DNA binding Function of p53", Cell, 1995, vol. 83, pp. 237-245.

Jonassen, I., et al., "Finding Flexible Patterns in Unaligned Protein Sequences", Protein Science, 1995, vol. 4, pp. 1587-1595.

Benninghoff, B., et al., "Production of Citrulline and Ornithine by Interferon-γ Treated Macrophages", International Immunology, 1991, vol. 3, No. 5, pp. 413-417.

(56) References Cited

OTHER PUBLICATIONS

Ogawa, T., et al., "Virus-Induced Cell Death in Plants Expressing the Mammalian 2', 5' Oligoadenylate System", Nature Biotechnology, 1996, vol. 14, pp. 1566-1569.
Ishige, F., et al., "A G-box Motif (GCCACGTGCC) Tetramer Confers High-Level Constitutive Expression in Dicot and Monocot Plants", The Plant Journal, 1999, vol. 18, No. 4, pp. 443-448.
Ding, Y., et al., "Direct Determination of Free Amino Acids and Sugars in Green Tea by Anion-Exchange Chromatography with Integrated Pulsed Amperometric Detection", Journal of Chromatography A, 2002, vol. 982, pp. 237-244.
Bock, R., "Transgenic Plastids in Basic Research and Plant Biotechnology", J. Mol. Biol., 2001, vol. 312, pp. 425-438.
Feng, D-F., et al., "Progressive Sequence Alignment as a Prerequisite to Correct Phylogenetic Trees", J. Mol. Evol., 1987, vol. 25, pp. 351-360.
Jackson, B. J., et al., "Biosynthesis of Asparagine-Linked Oligosaccharides in *Saccharomyces cerevisiae*,: The *alg2* mutation", Glycobiology, 1993, vol. 3, No. 4, pp. 357-364.
Jacq, C., et al., "The Nucleotide Sequence of *Saccharomyces cerevisiae* Chromosome IV", Nature, 1997, vol. 387, pp. 75-78.
Jain, R. K., et al., "Isolation and Characterization of Two Promoters from Linseed for Genetic Engineering", Crop Science, 1999, vol. 39, pp. 1696-1701.
Jander, G., et al., "Application of High-Throughput HPLC-MS/MS Assay to *Arabidopsis* Mutant Screening: Evidence that Threonine Aldolase Plays a Role in Seed Nutritional Quality", The Plant Journal, 2004, vol. 39, pp. 465-475.
Jang, H-D., et al., "Polyunsaturated Fatty Acid Production with *Mortierella alpine* by Solid Substrate Fermentation", Bot. Bull. Acad. Sin., 2000, vol. 41, pp. 41-48.
Jeon, J-S., et al., "T-DNA Insertional Mutagenesis for Functional Genomics in Rice", The plant Journal, 2000, vol. 22, No. 6, pp. 561-570.
Jiang, B., et al., "A New Family of Yeast Genes Implicated in Ergosterol Synthesis is Related to the Human Oxysterol Binding Protein", Yeast, 1994, vol. 10, pp. 341-353.
Johnston, M., et al., "The Nucleotide Sequence of *Saccharomyces cerevisiae* Chromosome XII", Nature, 1997, vol. 387, pp. 87-90.
Johnston, M., et al., "Complete Nucleotide Sequence of *Saccharomyces cerevisiae* Chromosome VIII", Science, 1994, vol. 265, pp. 2077-2082.
Jones, J. D. G., et al., "High Level Expression of Introduced Chimaeric Genes in Regenerated Transformed Plants", EMBO J., 1985, vol. 4, pp. 2411-2418.
Okuyama, H., et al., "A *trans*-Unsaturated Fatty Acid in a Psychrophilic Bacterium, *Vibrio* sp. Strain ABE-1", Journal of Bacteriology, 1990, vol. 172, No. 6, pp. 3515-3518.
Kakimi, K., et al., "Natural Killer T Cell Activation Inhibits Hepatitis B Virus Replication In Vivo", J. Exp. Med. 2000, vol. 192, No. 7, pp. 921-930.
Kaneko, T., et al., "Complete Genome Structure of the Unicellular Cyanobacterium *Synechocystis* sp. PCC6803", Plant Cell Physiol., 1997, vol. 38, No. 11, pp. 1171-1176.
Kaneko, T., et al., Sequence Analysis of the Genome of the Unicellular Cyanobacterium *Synechocystis* sp. Strain PCC6803. I. Sequence Features in the 1 Mb Region from Map Positions 64% to 92% of the Genome (Supplement), DNA Research, 1995, vol. 2, pp. 191-198.
Kaneko, T., et al., "Sequence Analysis of the Genome of the Unicellular Cyanobacterium *Synechocystis* sp. Strain PCC 6803. II. Sequence Determination of the Entire Genome and Assignment of Potential Protein-coding Regions", DNA Research, 1996, vol. 3, pp. 109-136.
Kaneko, T., et al., "Sequence Analysis of the Genome of the Unicellular Cyanobacterium *Synechocystis* sp. Strain PCC6803. II. Sequence Determination of the Entire Genome and Assignment of Potential Protein-coding Regions (Supplement)", DNA Research, 1996, vol. 3, pp. 185-209.

Katan, M. B., et al., "Efficacy and Safety of Plant Stanols and Sterols in the Management of Blood Cholesterol Levels", Mayo Clin Proc., 2003, vol. 78, pp. 965-978.
Kaya, K., et al., "On the Formation of α-Hydroxy Fatty Acids", The Journal of Biological Chemistry, 1984, vol. 259, No. 6, pp. 3548-3553.
Keegstra, K., et al., "Chloroplastic Precursors and their Transport Across the Envelope Membranes", Annu. Rev. Plant Physiol. Plant Mol. Biol., 1989, vol. 40, pp. 471-501.
Kermode, A. R., "Mechanisms of Intracellular Protein Transport and Targeting in Plant Cells", Critical Reviews in Plant Sciences, 1996, vol. 15, No. 4, pp. 285-423.
Klaus, S. M. J., et al., "Generation of Marker-Free Plastid Transformants using a Transiently Cointegrated Selection Gene", Nature Biotechnology, 2004, vol. 22, No. 2, pp. 225-229.
Knoblauch, M., et al., "A Galinstan Expansion Femtosyringe for Microinjection of Eukaryotic Organelles and Prokaryotes", Nature Biotechnology, 1999, vol. 17, pp. 906-910.
Kochevenko, A., et al., "Chimeric RNA/DNA Oligonucleotide-Based Site-Specific Modification of the Tobacco Acetolactate Syntase Gene", Plant Physiology, 2003, vol. 132, pp. 174-184.
Köhler, G., et al., "Continuous Cultures of Fused Cells Secreting Antibody of Predefined Specificity", Nature, 1975, vol. 256, pp. 495-497.
Koncz, C., et al., "The Promoter of $T_L$-DNA Gene 5 Controls the Tissue-Specific Expression of Chimaeric Genes Carried by a Novel Type of *Agrobacterium* Binary Vector", Mol Gen Genet, 1986, vol. 204, pp. 383-396.
Koprek, T., et al., "An Efficient Method for Dispersing *Ds* Elements in the Barley Genome as a Tool for Determining Gene Function", The Plant Journal, 2000, vol. 24, No. 2, pp. 253-263.
Kotani, H., et al., "Lessons from Sequencing of the Genome of a Unicellular Cyanobacterium, *Synechocystis* Sp. PCC6803", Annu. Rev. Physiol. Plant Mol. Biol., 1998, vol. 49, pp. 151-171.
Krysan, P. J., et al., "T-DNA as an Insertional Mutagen in *Arabidopsis*", The Plant Cell, 1999, vol. 11, pp. 2283-2290.
Kumar, L. S., "DNA Markers in Plant Improvement: An Overview", Biotechnology Advances, 1999, vol. 17, pp. 143-182.
Kuninaka, A., "Nucleotides and Related Compounds", Biotechnology, 1996, vol. 6, Chapter 15, pp. 561-612.
Kurjan, J., et al., "Structure of a Yeast Pheromone Gene (*MF* α): A Putative α-Factor Precursor Contains Four Tandem Copies of Mature α-Factor", Cell, 1982, vol. 30, pp. 933-943.
Lassner, M. W., et al., "A Jojoba β-Ketoacyl-CoA Synthase cDNA Complements the Canola Fatty Acids Elongation Mutation in Transgenic Plants", The Plant Cell, 1996, vol. 8, pp. 281-292.
Lawrence, S. D., et al., "Alterations in the *Chlamydomonas* Plastocyanin Transit Peptide Have Distinct Effects on in Vitro Import and in Vivo Protein Accumulation", The Journal of Biological Chemistry, 1997, vol. 272, No. 33, pp. 20357-20363.
Lee, D. P., et al., A Novel pathway for Lipid Biosynthesis: The Direct Acylation of Glycerol, Journal of Lipid Research, 2001, vol. 42, pp. 1979-1986.
Leisner, S. M., et al., "Structure of the Octopine Synthase Upstream Activator Sequence", Proc. Natl. Acad. Sci. USA, 1998, vol. 85, pp. 2553-2557.
Leuchtenberger, W., "Amino Acids—Technical Production and Use", Industrial Production of Amino Acids, 1996 vol. 2, Chapter 14, pp. 466-502.
Liu, J-M., et al., "Plant Gene Register PGR 99-094, Cloning and Sequencing of the cDNA (Accession No. AF090734) Coding for Glycerol-3-Phosphate Acyltransferase from Fava Bean", Plant Physiol., 1999, vol. 120, p. 934.
Lubben, T. H., et al., "Transport of Proteins into Chloroplasts", Photosynthesis Research, 1988, vol. 17, pp. 173-194.
Luckow, V. A., et al., "High Level Expression of Nonfused Foreign Genes with *Autographa* Californica Nuclear Polyhedrosis Virus Expression Vectors", Virology, 1989, vol. 170, pp. 31-39.
Ludwig, R. A., "*Arabidopsis* Chloroplasts Dissimilate $_L$-Arginine and $_L$-Citrulline for Use as N Source", Plant Physiol., 1993, vol. 101, pp. 429-434.
Lüttge, U., et al., "The Role of Vacuolar Malate-Transport Capacity in Crassulacean Acid Metabolism and Nitrate Nutrition. Higher

(56) References Cited

OTHER PUBLICATIONS

Malate-Transport Capacity in Ice Plant after Crassulacean Acid Metabolism-Induction and in Tobacco under Nitrate Nutrition", Plant Physiology, 2000, vol. 124, pp. 1335-1347.
Ma, J. K.-C., et al., "Plant Expression Systems for the Production of Vaccines", Curr Top Microbiol Immunol., 1999, vol. 236, pp. 275-292.
Malakhova, I. I., et al., "Thin-Layer Chromatography of Free Amino Acids. Selection of Conditions for the Separation of L-Lysine, L-Homoserine, and L-Threonine", Russian Biotechnology, 1996, No. 11, pp. 26-31.
Maliga, P., "Progress Towards Commercialization of Plastid Transformation Technology", Trends in Biotechnology, 2003, vol. 21, No. 1, pp. 20-28.
Marcell, L. M., et al., "Effect of Leaf Surface Waxes on Leaf Colonization by *Pantoea agglomerans* and *Clavibacter michiganensis*", Molecular Plant-Microbe Ineractions, 2002, vol. 15, No. 12, pp. 1236-1244.
Matsura, T., et al "Difference in Antioxidant Activity Between Reduced Coenzyme $Q_9$ and Reduced Coenzyme $Q_{10}$ in the Cell: Studies with Isolated Rat and Guinea Pig Hepatocytes Treated with a Water-Soluble Radical Initiator", Biochimica et Biophysica Acta, 1992, vol. 1123, pp. 309-315.
Matthes, B., et al., "Chioroacetamides Affect the Plasma Membrane", Herbicides Affect the Plasma Membrane, Z. Naturforsch, 2002, 57C, pp. 843-852.
Matthes, B., "Die Wirkungsweise Herbizidaler Chloracetamide", Dissertation zur Erlangung des Akademischen Grades des Doktors der Naturwissenschaften, 2000, pp. 1-108.
Matthews, B. F., "Lysine, Threonine, and Methionine Biosynthesis", Lys, Thr, and Met Biosynthesis Plant Amino Acids: Biochemistry and Biotechnology, 1997, pp. 205-225.
Mattila, P., et al., "Determination of Free and Total Phenolic Acids in Plant-Derived Foods by HPLC with Diode-Array Detection", J. Agric. Food. Chem., 2002, vol. 50, pp. 3660-3667.
McKeon, T., et al., "Stearoyl-Acyl Carrier Protein Desaturase from Safflower Seeds", Methods in Enzymology, 1981, vol. 71, pp. 275-281.
McKersie, B. D., et al., "Winter Survival of Transgenic Alfalfa Overexpressing Superoxide Dismutase", Plant Physiology, 1999, vol. 119, pp. 839-847.
McLellan, M. R., et al., "Maintenance of Algae and Protozoa", Algae and Protozoa, 1991, pp. 183-208.
McLeod, M., et al., "The Product of the *mei3+* Gene, Expressed Under Control of the Mating-Type Locus, Induces Meiosis and Sporulation in Fission Yeast", The EMBO Journal, 1987, vol. 6, No. 3, pp. 729-736.
Mermet-Bouvier, P., et al., "A Conditional Expression Vector for the Cyanobacteria *Synechocystis* sp. Strains PCC6803 and PCC6714 or *Synechococcus* sp. Strains PCC7942 and PCC6301", Current Microbiology, 1994, vol. 28, pp. 145-148.
Mermet-Bouvier, P., et al., "Transfer and Replication of RSF1010-Derived Plasmids in Several Cyanobacteria of the Genera *Synechocystis* and *Synechococcus*", Current Microbiology, 1993, vol. 27, pp. 323-327.
Mewes, H. W., et al., "MIPS: A Database for Genomes and Protein Sequences", Nucleic Acids Research, 1999, vol. 27, No. 1, pp. 44-48.
Michaelson, L. V., et al., "Functional Identification of a Fatty Acid $\Delta^5$ Desaturase Gene from *Caenorhabditis elegans*", FEBS Letters, 1998, vol. 439, pp. 215-218.
Milner, J., "DNA Damage, p53 and Anticancer Therapies", Nature Medicine, 1995, vol. 1, No. 9, pp. 879-880.
Minard, K. I., et al., "Isolation, Nucleotide Sequence Analysis, and Disruption of the *MDH2* Gene from *Saccharomyces cerevisiae*: Evidence for Three Isozymes of Yeast Malate Dehydrogenase", Molecular and Cellular Biology, 1991, vol. 11, No. 1, pp. 370-380.
Miwa, T. K., "Jojoba Oil Wax Esters and Derived Fatty Acids and Alcohols: Gas Chromatographic Analyses", J Am Oil Chem Soc, vol. 48, pp. 259-264, (1971).

Monge, A., et al., "Computer Modeling of Protein Folding: Conformational and Energetic Analysis of Reduced and Detailed Protein Models", J. Mol. Biol., 1995, vol. 247, pp. 995-1012.
Moore, J. C., et al, "Directed Evolution of a *Para*-Nitrobenzyl Esterase for Aqueous-Organic Solvents", Nature Biotechnology, 1996, vol. 14, pp. 458-467.
Van Den I Iondel, C. A. M. J. J., et al., "Heterologous Gene Expression in Filamentous Fungi", More Gene Manipulations in Fungi, 1991, Chapter 18, pp. 396-428.
Müller, H., "Determination of the Carotenoid Content in Selected Vegetables and Fruit by HPLC and Photodiode Array Detection", Z Lebensm Unter Forsch A, 1997, vol. 204, pp. 88-94.
Murphy, R. C., et al., "Cloning and Expression of the *cryIVD* Gene of *Bacillus thuringiensis* subsp. *israelensis* in the Cyanobacterium *Agmenellum quadruplicatum* PR-6 and Its Resulting Larvicidal Activity", Applied and Environmental Microbiology, 1992, vol. 58, No. 5, pp. 1650-1655.
Nair, R. B., et al., "The *Arabidopsis thaliana* Reduced Epidermal Fluorescence1 Gene Encodes and Aldehyde Dehydrogenase Involved in Ferulic Acid and Sinapic Acid Biosynthesis", The Plant Cell, 2004, vol. 16, pp. 544-554.
Nakata, K., "High Resistance to Oxygen Radicals and Heat is Caused by a Galactoglycerolipid in *Microbacterium* sp. M874", J. Biochem., 2000, vol. 127, pp. 731-737.
Napier, J. A., et al., "Genomic and Functional Characterization of Polyunsaturated Fatty Acid Biosynthesis in *Caenorhabditis elegans*", Lipids, 2001, vol. 36, No. 8, pp. 761-766.
Nanvarro, J-A., et al., "A Chloroplastic RNA Polymerase Resistant to Tagetitoxin is Involved in Reglication of Avocado Sunblotch Viroid", Virology, 2000, vol. 268, pp. 218-225.
Needleman, S. B., et al., "A General Method Applicable to the Search for Similarities in the Amino Acid Sequence of Two Proteins", J. Mol. Biol., 1970, vol. 48, pp. 443-453.
Noda, M., et al., "Sinapic Acid and Methyl Sinapate in Rapeseed Lipids", Biochimica et Biophysica Acta, 1971, vol. 231, pp. 131-133.
Norris, S. R., et al., "Genetic Dissection of Carotenoid Synthesis in *Arabidopsis* Defines Plastoquinone as an Essential Component of Phytoene Desaturation", The Plant Cell, 1995, vol. 7, pp. 2139-2149.
O'Neill, C., et al., "Chloroplast Transformation in Plants: Polyethylene Glycol (PEG) Treatment of Protoplasts is an Alternative to Biolistic Delivery Systems", The Plant Journal, 1993, vol. 3, No. 5, pp. 729-738.
Odell, J. T., et al., "Identification of DNA Sequences Required for Activity of the Cauliflower Mosaic Virus 35S Promoter", Nature, 1985, vol. 313, pp. 810-812.
Olszewski, K. A., et al., "Folding Simulations and Computer Redesign of Protein A Three-Helix Bundle Motifs", Proteins: Structure, Function, and Genetics, 1996, vol. 25, pp. 286-299.
Ordiz, M. I., et al., "Regulation of Transgene Expression in Plants with Polydactyl Zinc Finger Transcription Factors", PNAS, 2002, vol. 99, No. 20, pp. 13290-13295.
Osawa, H., et al., "Possible Involvement of Protein Phosphorylation in Aluminum-Responsive Malate Efflux from Wheat Root Apex", Plant Physiology, 2001, vol. 126, pp. 411-420.
Pabo, C. O., et al., "Computer-Aided Model-Building Strategies for Protein Design", Biochemistry, 1986, vol. 25, pp. 5987-5991.
Maliga, P., "Plastid Transformation in Higher Plants", Annu. Rev Plant Biol., 2004, vol. 55, pp. 289-313.
Panikulangara, T. J., et al., "Galactinol synthase1. A Novel Heat Shock Factor Target Gene Responsible for Heat-Induced Synthesis of Raffinose Family Oligosaccharides in *Arabidopsis*", Plant Physiology, 2004, vol. 136, pp. 3148-3158.
Pedrotta, V., et al., "Isolation and Characterization of the *cis-trans*-Unsaturated Fatty Acid Isomerase of *Pseudomonas oleovorans* GPo12", Journal of Bacteriology, 1999, vol. 181, No. 10, pp. 3256-3261.
Peleman, J. D., et al., "Breeding by Design", Trends in Plant Science, 2003, vol. 8, No. 7, pp. 330-334.
Smith, D. B., et al., "Single-Step Purification of Polypeptides Expressed in *Escherichia coli* as Fusions with Glutathione S-transferase", Gene, 1988, vol. 67, pp. 31-40.

(56) References Cited

OTHER PUBLICATIONS

Philippsen, P., et al., "The Nucleotide Sequence of *Saccharomyces cerevisiae* Chromosome XIV and its Evolutionary Implications", Nature, 1997, vol. 387, pp. 93-98.
Methods in Plant Molecular Biology and Biotechnology, 1993, Chapters 6 & 7, pp. 71-119.
Kathiresan, A., et al., "γ-Aminobutyric Acid Stimulates Ethylene Biosynthesis in Sunflower", Plant Physiol., 1997, vol. 115, pp. 129-135.
Plesch, G., et al., "Involvement of TAAAG Elements Suggests a Role for Dof Transcription Factors in Guard Cell-Specific Gene Expression", The Plant Journal, 2001, vol. 28, No. 4, pp. 455-464.
Potrykus, I., "Gene Transfer to Plants: Assessment of Published Approaches and Results", Annu. Rev. Plant Physiol. Plant Mol. Biol., 1991, vol. 42, pp. 205-225.
Provasoli, L., et al., "Artificial Media for Fresh-Water Algae: Problems and Suggestions", The Ecology of Algae, 1959, pp. 84-96.
Ramputh, A-I., et al., "Rapid γ-Aminobutyric Acid Synthesis and the Inhibition of the Growth and Development of Oblique-Banded Leaf-Roller Larvae", Plant Physiol., 1996, vol. 111, pp. 1349-1352.
Rawat, S. R., et al., "*AtAMT1* Gene Expression and $NH_4+$ Uptake in Roots of *Arabidopsis thaliana*: Evidence for Regulation by Root Glutamine Levels", The Plant Journal, 1999, vol. 19, No. 12, pp. 143-152.
Datar, R. V., et al., "Cell and Cell Debris Removal: Centrifugation and Crossflow Filtration", Biotechnology, 1993, vol. 3, Chapter 18, pp. 469-714.
Rellos, P., et al., "Polymerase Chain Reaction-Based Random Mutagenesis: Production and Characterization of Thermostable Mutants of *Zymomonas mobilis* Alcohol Dehydrogenase-2", Protein Expression and Purification, 1994, vol. 5, pp. 270-277.
Ren, L., et al., "Expression of the Mouse Metallothionein-I gene Conferring Cadmium Resistance in a Transgenic Cyanobacterium", FEMS Microbiology Letters, 1998, vol. 158, pp. 127-132.
Renouf, D. V., et al., "Molecular Modelling of Glycoproteins by Homology with Non-Glycosylated Protein Domains, Computer Simulated Glycosylation and Molecular Dynamics", Adv. Exp. Med. Biol., 1995, vol. 376, pp. 37-45.
Riederer, M., et al., "Protecting Against Water Loss: Analysis of the Barrier Properties of Plant Cuticles", Journal of Experimental Botany, 2001, vol. 52, No. 363, pp. 2023-2032.
Romanos, M. A., et al., "Foreign Gene Expression in Yeast: A Review", Yeast, 1992, vol. 8, pp. 423-488.
Römer, S., et al., "Expression of the Genes Encoding the Early Carotenoid Biosynthestic Enzymes in *Capsicum annuum*", Biochemical and Biophysical Research Communications, 1993, vol. 196, No. 3, pp. 1414-1421.
Ruegger, M., et al., "Regulation of Ferulate-5-Hydroxylase Expression in *Arabidopsis* in the Context of Sinapate Ester Biosynthesis", Plant Physiology, 1999, vol. 119, pp. 101-110.
Rupp, W. D., "DNA Repair Mechanisms", *Escherichia coli* and *Salmonella*, 1996, vol. 2, pp. 2277-2294.
Rushton, P. J., et al., "Synthetic Plant Promoters Containing Defined Regulatory Elements Provide Novel Insights into Pathogen- and Wound-Induced Signaling", The Plant Cell, 2002, vol. 14, pp. 749-762.
Russell, P. R., et al., "The Primary Structure of the Alcohol Dehydrogenase Gene from the Fission Yeast *Schizosaccharomyces pombe*", The Journal of Biological Chemistry, 1983, vol. 258, No. 1, pp. 143-149.
Höfgen, R., et al., "Storage of Competent Cells for *Agrobacterium* Transformation", Nucleic Acid Research, 1988, vol. 16, No. 20, p. 9877.
Sandhu, J. S., et al., "A/T-Rich Sequences Act as Quantitative Enhancers of Gene Expression in Transgenic Tobacco and Potato Plants", Plant Molecular Biology, 1998, vol. 37, pp. 885-896.
Sanger, M., et al., "Characteristics of a Strong Promoter from Figwort Mosaic Virus: Comparison with the Analogous 35S Promoter from Cauliflower Mosaic Virus and the Regulated Mannopine synthase Promoter", Plant Molecular Biology, 1990, vol. 14, pp. 433-443.
Sayanova, O., et al., "Mutagenesis and Heterologous Expression in Yeast of Plant $\Delta^6$-Fatty Acid Desaturase", Journal of Experimental Botany, 2001, vol. 52, No. 360, pp. 1581-1585.
Schaller, H., et al., "Overexpression of an *Arabidopsis* cDNA Encoding a Sterol-C24$^1$-Methyltransferase in Tobacco Modifies the Ratio of 24-Methyl Cholestrol to Sitosterol and Is Associated with Growth Reduction", Plant Physiol., 1998, vol. 118, pp. 461-469.
Schenk, P. M., et al., "A Promoter from Sugarcane Bacilliform Badnavirus Drives Transgene Expression in Banana and Other Monocot and Dicot Plants", Plant Molecular Biology, 1999, vol. 39, pp. 1221-1230.
Schier, R., et al., "Efficient in vitro Affinity Maturation of Phage Antibodies Using BIAcore Guided Selections", Hum. Antibod. Hybridomas, 1996, vol. 7, No. 3, pp. 97-105.
Malmborg, A-C., et al., "BIAcore as a Tool in Antibody Engineering", Journal of Immunological Methods, 1995, vol. 183, pp. 7-13.
Schmidt, S., et al., "Near Infrared Spectroscopy in Fermentation and Quality Control for Amino Acid Production", Bioprocess Engineering, 1998, vol. 19, pp. 67-70.
Schmidt, R., et al., "High Efficiency *Agrobacterium tumefaciens*-mediated Transformation of *Arabidopsis thaliana* Leaf and Cotyledon Explants", Plant Cell Reports, 1988, vol. 7, pp. 583-586.
Schomburg, F. M., et al., "Overexpression of a Novel Class of Gibberellin 2-Oxidases Decreases Gibberellin Levels and Created Dwarf Plants", The Plant Cell, 2003, vol. 15, pp. 151-163.
Schultz, L. D., et al., "Expression and Secretion in Yeast of a 400-kDa Envelope Glycoprotein Derived from Epstein-Barr Virus", Gene, 1987, vol. 54, pp. 113-123.
Sessions, A., et al., "A High-Throughput *Arabidopsis* Reverse Genetics System", The Plant Cell, 2002, vol. 14, pp. 2985-2994.
Shaeiwitz, J. A., et al., "Biochemical Separation", Ullmann's Encyclopedia of Industrial Chemistry, 1988, vol. B3, Chapter 11, pp. 1-27.
Shallenberger, R. S., et al., "Relation Between Changes in Glucose, Fructose, Galactose, Sucrose, and Stachyose, and the Formation of Starch in Peas", J. Agric. Food Chem., 1961, vol. 9, No. 2, pp. 137-140.
Sharma, N., et al., "Purification and Characterization of Dihydroxyacetone Phosphate Reductase from Immature Seeds of *Brassica campestris* L.", Plant Science, 2001, vol. 160, pp. 603-610.
Shaw, C. H., et al., "A Functional Map of the Nopaline Synthase Promoter", Nucleic Acids Research, 1984, vol. 12, No. 20, pp. 7831-7846.
Shelp, B. J., et al., "Gamma Aminobutyrate: From Intellectual Curiosity to Practical Pest Control", Can. J. Bot., 2003, vol. 81, pp. 1045-1048.
Shen, W., et al., "Identification of a Mitochondrial Glycerol-3-Phosphate Dehydrogenase from *Arabidopsis thaliana*: Evidence for a Mitochondrial Glycerol-3-Phosphate Shuttle in Plants", FEBS Letters, 2003, vol. 536, pp. 92-96.
Sherman, F., et al., "Experiment XIX Transformation of Yeast and Analysis of Transformants", Methods in Yeast Genetics, 1982, pp. 90-98.
Sikdar, S. R., et al., "Plastid Transformation in *Arabidopsis thaliana*", Plant Cell Reports, 1998, vol. 18, pp. 20-24.
Smith, T. F., et al., "Comparison of Biosequence", Advances in Applied Mathematics, 1981, vol. 2, pp. 482-489.
Smith, G. E., et al., "Production of Human Beta Interferon in Insect Cells Infected with a Baculovirus Expression Vector", Molecular and Cellular Biology, 1983, vol. 3, No. 12, pp. 2156-2165.
Solinger, J. A., et al., "Rad54 Protein Stimulates the Postsynaptic phase of Rad51 Protein-Mediated DNA Strand Exchange", PNAS, 2001, vol. 98, No. 15, pp. 8447-8453.
Soni, R., et al., "A Rapid and Inexpensive Method for Isolation of Shuttle Vector DNA from Yeast for the Transformation of *E.coli*", Nucleic Acids Research, 1992, vol. 20, No. 21, p. 5852.
Sonnewald, U., et al., "Increased Potato Tube Size Resulting from Apoplastic Expression of a Yeast Invertase", Nature Biotechnology, 1997, vol. 15, pp. 794-797.
Spee, J. H., et al., "Efficient Random Mutagenesis Method with Adjustable Mutation Frequency by use of PCR and dITP", Nucleic Acids Research, 1993, vol. 21, No. 3, pp. 777-778.

(56) References Cited

OTHER PUBLICATIONS

Sperling, P. et al., "Functional Identification of a Δ⁸-Sphingolipid Desaturase from *Borago officinalis*", Archives of Biochemistry and Biophysics, 2001, vol. 388, No. 2, pp. 293-298.
Sperling, P., et al., "Plant Sphingolipids: Structural Diversity, Biosynthesis, First Genes and Functions", Biochimica et Biophysica Acta, 2003, vol. 1632, pp. 1-15.
Speulman, E., et al., "A Two-Component Enhancer-Inhibitor Transposon Mutagenesis System for Functional Analysis of the *Arabidopsis* Genome", The Plant Cell, 1999, vol. 11, pp. 1853-1866.
Starr, R. C., "Algal Cultures—Sources and Methods of Cultivation", Isolation and Culture Techniques, 1971, vol. 2, pp. 29-53.
Stemmer, W. P. C., "DNA Shuffling by Random Fragmentation and Reassembly: In vitro Recombination for Molecular Evolution", Proc. Natl. Acad. Sci. USA, 1994, vol. 91, pp. 10747-10751.
Stockhaus, J., et al., "Correlation of the Expression of the Nuclear Photosynthetic Gene ST-LS1 with the Presence of Chloroplasts", The EMBO Journal, 1989, vol. 8, No. 9, pp. 2445-2451.
Stoesser, G., et al., "The EMBL Nucleotide Sequence Database", Nucleic Acids Research, 2001, vol. 29, No. 1, pp. 17-21.
Studier, F. W., et al., "Use of T7 RNA Polymerase to Direct Expression of Cloned Genes", Methods in Enzymology, 1990, vol. 185, vol. 6, pp. 60-89.
Stukey, J. E., et al., "The *OLE1* Gene of *Saccharomyces cerevisiae* Encodes the Δ9 Fatty Acid Desaturase and Can Be Functionally Replaced by the Rat Stearcyl-CoA Desaturase Gene", The Journal of Biological Chemistry, 1990, vol. 265, No. 33, pp. 20144-20149.
Tarpley, L., et al., "Biomarker Metabolites Capturing the Metabolite Variance Present in a Rice Plant Developmental Period", BMC Plant Biology, 2005, vol. 5, No. 8, pp. 1-12.
Sutcliffe, J. G., "Nucleotide Sequence of the Ampicillin Resistance Gene of *Escherichia coli* Plasmid pBR322", Proc. Natl. Acad. Sci. USA, 1978, vol. 75, No. 8, pp. 3737-3741.
Svab, Z., et al., "High-Frequency Plastid Transformation in Tobacco by selection for a Chimeric *aadA* Gene", Proc. Natl. Acad. Sci. USA, 1993, vol. 90, pp. 913-917.
Svab, Z., et al., "Stable Transformation of Plastids in Higher Plants", Proc. Natl. Acad. Sci. USA, 1990, vol. 87, pp. 8526-8530.
Symolon, H., et al., "Dietary Soy Sphingolipids Suppress Tumorigenesis and Gene Expression in 1,2-Dimethylhydrazine-Treated CF1 Mice and $Apc^{Min/+}$ Mice", J. Nutr., 2004, vol. 134, No. 5, pp. 1157-1161.
Takeshima, Y., et al., "High-Level Expression of Human Superoxide Dismutase in the Cyanobacterium Anacystis nidulans 6301", PNAS, 1994, vol. 91, pp. 9685-9689.
Tettelin, H., et al., "The Nucleotide Sequence of *Saccharomyces cerevisiae* Chromosome VII", Nature, 1997, vol. 387, pp. 81-84.
Leray, C., et al., "Simultaneous Determination of Homologues of Vitamin E and Coenzyme Q and Products of α-Tocopherol Oxidation", Journal of Lipid Research, 1998, vol. 39, pp. 2099-2105.
Tissier, A. F., et al., "Multiple Independent Defective Suppressor-mutator Transposon Insertions in *Arabidopsis*: A Tool for Functional Genomics", The Plant Cell, 1999, vol. 11, pp. 1841-1852.
Töpfer, R., et al., "Modification of Plant Lipid Synthesis", Science, 1995, vol. 268, pp. 681-686.
Tosaka, O., "Lysine", Progress in Industrial Microbiology, 1986, vol. 14, pp. 152-172.
Tosaka, O., et al., "The Production of L-Lysine by Fermentation", Trends in Biotechnology. 1983, vol. 1, No. 3, pp. 70-74.
Hellens, R., et al., "A Guide to *Agrobacterium* binary Ti Vectors", Trends in Plant Science, 2000, vol. 5, No. 10, pp. 446-452.
Tribble, G., et al., "DNA Recognition, Strand Selectivity, and Cleavage Mode during Integrase Family Site-Specific Recombination", The Journal of Biological Chemistry, 2000, vol. 275, No. 29, pp. 22255-22267.
"Amino Acids", Ullmann's Encyclopedia of Industrial Chemistry, 1985, vol. A2, 89-90.
"Enzymes", Ullmann's Encyclopedia of Industrial Chemistry, 1987, vol. A9, pp. 352-363.
"Vitamins", Ullmann's Encyclopedia of Industrial Chemistry, 1987, vol. 27, pp. 541-546.
"Vitamins". Ullmann's Encyclopedia of Industrial Chemistry, 1987, vol. 27, pp. 559-566.
"Amino Acids", Ullmann's Encyclopedia of Industrial Chemistry, 1987, vol. 27, pp. 89-90.
"Vitamins", Ullmann's Encyclopedia of Industrial Chemistry, 1987, vol. 27, pp. 521-540.
"Vitamins", Ullmann's Encyclopedia of Industrial Chemistry, 1987, vol. 27, pp. 575-581.
"Vitamins", Ullmann's Encyclopedia of Industrial Chemistry, 1987, vol. 27, pp. 581-587.
Umbarger, H. E., "Amino Acid Biosynthesis and Its Regulation", Ann. Rev. Biochem., 1978, vol. 47, pp. 533-606.
Iso, H., et al., "Linoleic Acid, Other Fatty Acids, and the Risk of Stroke", Stroke, 2002, vol. 33, pp. 2086-2093.
Van Den Hondel, C. A. M. J. J., et al., "Gene transfer systems and vector development for filamentous fungi", Applied Molecular Genetics of Fungi, 1991, Chapter 1, pp. 1-28.
Velmurugan, S., et al., "Partitioning of the 2-μm Circle Plasmid of *Saccharomyces cerevisiae*: Functional Coordination with Chromosome Segregation and Plasmid-Encoded Rep Protein Distribution", The Journal of Cell Biology, 2000, vol. 149, No. 3, pp. 553-566.
Bongaerts, R. J. M., et al., "Chorismate Utilizing Enzymes and Terpenoid Indole Alkaloid Biosynthesis", Pharmacy World & Science, 1995, vol. 17, No. 6, p. N6.
Verberne, M. C., et al., "Overproduction of Salicylic Acid in Plants by Bacterial Transgenes Enhances Pathogen Resistance", Nature Biotechnology, 2000, vol. 18, pp. 779-783.
Vigeolas, H., et al., "Increased Levels of Glycerol-3-Phosphate Lead to a Stimulation of Flux into Triacyclglycerol Synthesis after Supplying Glycerol to Developing Seeds of *Brassica napus* L. in planta", Planta, 2004, vol. 219, pp. 827-835.
Pearson, W. R., "Rapid and Sensitive Sequence Comparison with FASTP and FASTA", Methods in Enzymology, 1990, vol. 183, pp. 63-98.
Pearson, W. R., et al., "Improved Tools for Biological Sequence Comparison", Proc. Natl. Acad. Sci. USA, 1988, vol. 85, pp. 2444-2448.
Wada, H., et al., "Enhancement of Chilling Tolerance of a Cyanobacterium by Genetic Manipulation of Fatty Acid Desaturation", Nature, 1990, vol. 347, pp. 200-203.
Walker, K. A., et al., "The Hormonal Control of Organ Formation in Callus of *Medicago sativa* L. Cultured In Vitro", Amer. J. Bot., 1978, vol. 65, No. 6, pp. 654-659.
Wang, Y., et al., "Functional Characterization of a Unique Liver Gene Promoter", The Journal of Biological Chemistry, 1994, vol. 269, No. 12, pp. 9137-9146.
Ward, E. R., et al., "Chemical Regulation of Transgene Expression in Plants", Plant Molecular Biology, 1993, vol. 22, pp. 361-366.
Weigel, D., et al., "Activation Tagging in *Arabidopsis*", Plant Physiology, 2000, vol. 122, pp. 1003-1013.
Williams, J. G. K., "Construction of Specific Mutations in Photosystem II Photosynthetic Reaction Center by Genetic Engineering Methods in *Synechocystis* 6803", Methods in Enzymology, 1988, vol. 167, pp. 766-778.
Wodak, S. J., "Computer-Aided Design in Protein Engineering", Ann. N.Y. Acad. Sci., 1987, vol. 501, pp. 1-13.
Wu, X, et al., "Mosquito Larvicidal Activity of Transgenic *Anabaena* Strain PCC 7120 Expressing Combinations of Genes from *Bacillus thuringiensis* subsp. *israelensis*", Applied and Environmental Microbiology, 1997, vol. 63, No. 12, pp. 4971-4975.
Yang, Y., et al., "Endogenous Salicyclic Acid Protects Rice Plants from Oxidative Damage Caused by Aging as Well as Biotic and Abiotic Stress", The Plant Journal, 2004, vol. 40, pp. 909-919.
Young, J. C., et al., "Efficient Screening of *Arabidopsis* T-DNA Insertion Lines Using Degenerate Primers", Plant Physiology, 2001, vol. 125, pp. 513-518.
Zeh, M., et al., "Antisense Inhibition of Threonine Synthase Leads to High Methionine Content in Transgenic Potato Plants", Plant Physiology, 2001, vol. 127, pp. 792-802.
Zhang, X-H., et al., "Targeting a Nuclear Anthranilate Synthase α-Subunit Gene to the Tobacco Plastid Genome Results in Enhanced

(56) References Cited

OTHER PUBLICATIONS

Tryptophan Biosynthesis. Return of a Gene to Its Pre-Endosymbiotic Origin", Plant Physiology, 2001, vol. 127, pp. 131-141.
Zhao, J., et al., "Immunological Characterization and Chloroplast Localization of the Tryptophan Biosynthetic Enzymes of the Flowering Plant *Arabidopsis thaliana*", The Journal of Biological Chemistry, 1995, vol. 270, No. 11, pp. 6081-6087.
Zhao, X., et al., "Mannosylerythritol Lipid Is a Potent Inducer of Apoptosis and Differentiation of Mouse Melanoma Cells in Culture", Cancer Research, 1999, vol. 59, pp. 482-486.
Zhuo, D., et al., "Regulation of a Putative High-Affinity Nitrate Transporter (*Nrt2;1At*) in Roots of *Arabidopsis thaliana*", The Plant Journal, 1999, vol. 17, No. 6, pp. 563-568.
Pátek, M. P., et al., "Leucine Synthesis in Corynebacterium Glutamicum: Enzyme Activities, Structure of leuA, and Effect of leuA Inactivation on Lysine Synthesis", Applied and Environmental Microbiology, 1994, vol. 60, No. 1, pp. 133-140.
Wang, X. M., et al., "Synthesis and Regulation of Linolenic Acid in Higher Plants", Physiol. Biochem., 1988, vol. 26, No. 6, pp. 777-792.
Karchi, H., et al., "Seed-Specific Expression of Bacterial Desensitized Aspartate Kirtase Increases the Production of Seed Threonine and Methionine Transgenic Tobacco", The Plant Journal, 1993, vol. 3, No. 5, pp. 721-727.
"Ubiquinone biosynthesis monooxygenase C0Q6; EC=1.14.13", XP002650554, retrieved from EBI accession No. UniProt:P53318; Database accession No. P53318. Oct. 1, 1996.
Bruce, B.D., "Chloroplast transit peptides: structure, function and evolution," Trends in Cell Biology (2002), vol. 10, pp. 440-447.
Partial European Search Report dated Jul. 15, 2011 in EP 06127389.
Falco, S.C., et al., "Transgenic Canola and Soybean Seeds with Increased Lysine," Bio/Technology (Jun. 1995), vol. 13, pp. 577-582.
Gin, P., et al., "The *Saccharomyces cerevisiae C0Q6* Gene Encodes a Mitochondrial Flavin-dependent Monooxygenase Required for Coenzyme Q Biosynthesis," The Journal of Biological Chemistry (Jul. 2003), vol. 278, No. 28, pp. 25308-25316.
Hoppmann, V., et al., "The potato granule bound starch synthase chloroplast transit peptide directs recombinant proteins to plastids," J. Plant Physiol. (2002), vol. 159, pp. 1061-1067.
Mann, V., et al., "Metabolic engineering of astaxanthin production in tobacco flowers," Nature Biotechnology (2000), vol. 18, pp. 888-892.
Ravanel, S., et al., "The specific features of methionine biosynthesis and metabolism in plants," Proc. Natl. Acad. Sci. USA (Jun. 1998), vol. 95, pp. 7805-7812.
"*Escherichia coli* xylose utilization enzyme xylH coding sequence", EBI Database Accession No. AEC78455, Dec. 1, 2005.
"*Escherichia coli* xylose utilization enzyme xylH amino acid sequence", EBI Database Accession No. AEC78456, Dec. 1, 2005.
"SubName: Full=Inner membrane permease of D-xylose ABC transporter", UniProt Database Accession No. Q8CZH8, Mar. 1, 2003.
Polashock, J. J., et al., "Expression of the Yeast Δ-9 Fatty Acid Desaturase in *Nicotiana tabacum*", Plant Physiol., vol. 100, (1992), pp. 894-901.
Extended European Search Report for EP 06 12 7389 dated May 24, 2012.

\* cited by examiner

PROCESS FOR DECREASING VERBASCOSE IN A PLANT BY EXPRESSION OF A CHLOROPLAST-TARGETED FIMD PROTEIN

INCORPORATION OF SEQUENCE LISTING

The contents of the following submission on compact discs are incorporated herein by reference in its entirety: two replacement copies of the Sequence Listing (COPY 1 and COPY 2), and a computer-readable form of the Sequence Listing (CRF COPY), all on CD-ROMs, each containing: file name: Final Sequence List-13195-00014-US, date recorded: Dec. 13, 2006, size: 330,624 KB.

The present invention relates to a process for the production of the fine chemical in a microorganism, a plant cell, a plant, a plant tissue or in one or more parts thereof, preferably in plastids. The invention furthermore relates to nucleic acid molecules, polypeptides, nucleic acid constructs, vectors, antibodies, host cells, plant tissue, propagation material, harvested material, plants, microorganisms as well as agricultural compositions and to their use.

Figure 1:
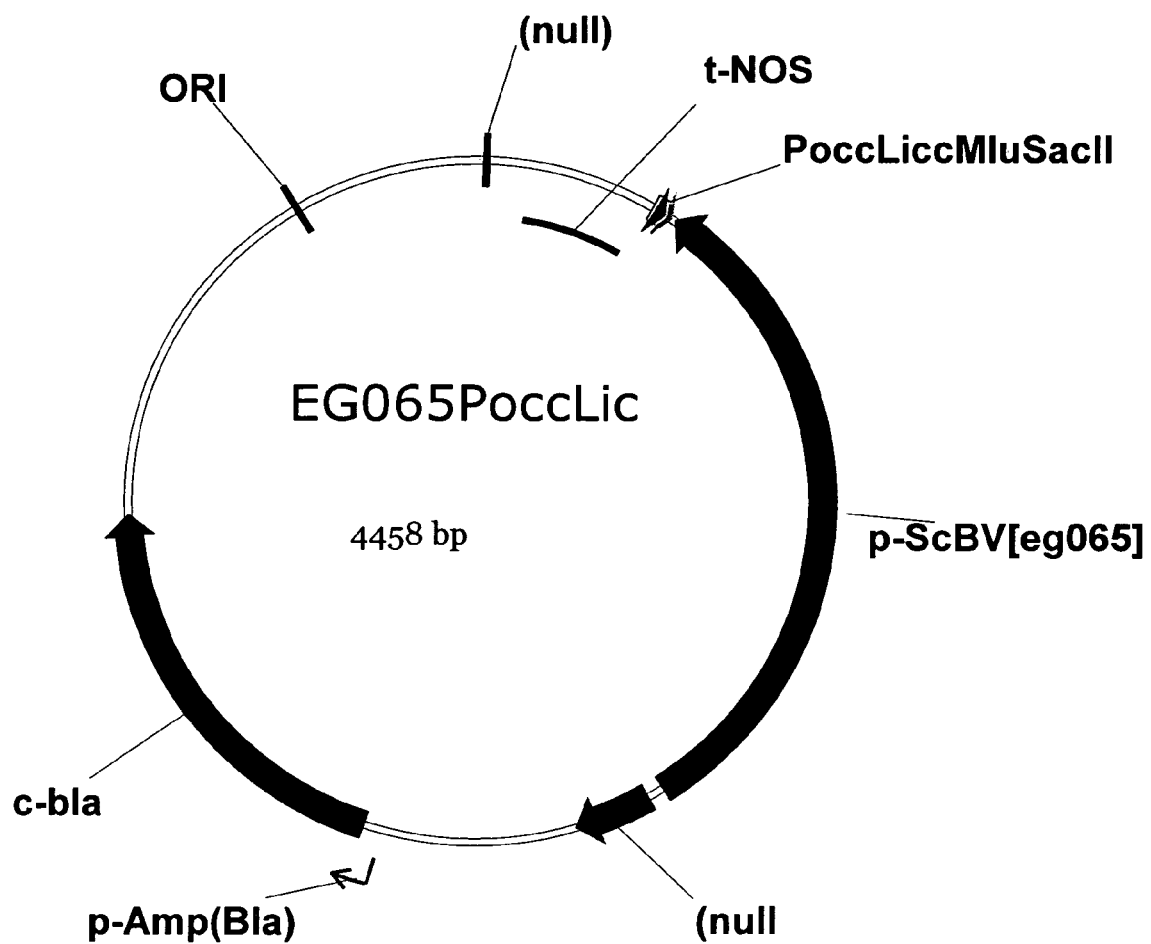
FIG. 1 depicts a vector map of EG065PoccLic (SEQ ID NO: 14587).

Amino acids are used in many branches of industry, including the food, animal feed, cosmetics, pharmaceutical and chemical industries. Amino acids such as D,L-methionine, L-lysine or L-threonine are used in the animal feed industry. The essential amino acids valine, leucine, isoleucine, lysine, threonine, methionine, tyrosine, phenylalanine and tryptophan are particularly important for the nutrition of humans and a number of livestock species. Glycine, L-methionine and tryptophan are all used in the pharmaceutical industry. Glutamine, valine, leucine, isoleucine, histidine, arginine, proline, serine and alanine are used in the pharmaceutical and cosmetics industries. Threonine, tryptophan and D,L-methionine are widely used feed additives (Leuchtenberger, W. (1996) Amino acids—technical production and use, pp. 466-502 in Rehm et al., (Ed.) Biotechnology vol. 6, chapter 14a, VCH Weinheim). Moreover, amino acids are suitable for the chemical industry as precursors for the synthesis of synthetic amino acids and proteins, such as N-acetylcysteine, S-carboxymethyl-L-cysteine, (S)-5-hydroxytryptophan and other subtances described in Ullmann's Encyclopedia of Industrial Chemistry, vol. A2, pp. 57-97, VCH Weinheim, 1985.

Over one million tonnes of amino acids are currently produced annually; their market value amounts to over 2.5 billion US dollars. They are currently produced by four competing processes: Extraction from protein hydrolysates, for example Lcystine, L-leucine or L-tyrosine, chemical synthesis, for example of D,L-methionine, conversion of chemical precursors in an enzyme or cell reactor, for example L-phenylalanine, and fermentative production by growing, on an industrial scale, bacteria which have been developed to produce and secrete large amounts of the desired molecule in question. An organism, which is particularly suitable for this purpose is *Corynebacterium glutamicum*, which is used for example for the production of L-lysine or L-glutamic acid. Other amino acids which are produced by fermentation are, for example, L-threonine, L-tryptophan, L-aspartic acid and L-phenylalanine.

The biosynthesis of the natural amino acids in organisms capable of producing them, for example bacteria, has been characterizied thoroughly; for a review of the bacterial amino acid biosynthesis and its regulation, see Umbarger, H. E. (1978) Ann. Rev. Biochem. 47: 533-606].

It is known that amino acids are produced by fermentation of strains of *coryneform* bacteria, in particular *Corynebacterium glutamicum*. Due to their great importance, the production processes are constantly being improved. Process improvements can relate to measures regarding technical aspects of the fermentation, such as, for example, stirring and oxygen supply, or the nutrient media composition, such as, for example, the sugar concentration during fermentation, or to the work-up to give the product, for example by ion exchange chromatography, or to the intrinsic performance properties of the microorganism itself. Bacteria from other genera such as *Escherichia* or *Bacillus* are also used for the production of amino acids. A number of mutant strains, which produce an assortment of desirable compounds from the group of the sulfur-containing fine chemicals, have been developed via strain selection. The performance properties of said microorganisms are improved with respect to the production of a particular molecule by applying methods of mutagenesis, selection and mutant selection. Methods for the production of methionine have also been developed. In this manner, strains are obtained which are, for example, resistant to antimetabolites, such as, for example, the methionine analogues α-methylmethionine, ethionine, norleucine, N-acetyl-norleucine, S-trifluoromethylhomocysteine, 2-amino-5-heprenoitic acid, selenomethionine, methionine sulfoximine, methoxine, 1-aminocyclopentanecarboxylic acid or which are auxotrophic for metabolites with regulatory importance and which produce sulfur-containing fine chemicals such as, for example, L-methionine. However, such processes developed for the production of methionine have the disadvantage that their yields are too low for being economically exploitable and that they are therefore not yet competitive with regard to chemical synthesis.

Zeh (Plant Physiol., Vol. 127, 2001: 792-802) describes increasing the methionine content in potato plants by inhibiting threonine synthase by what is known as antisense technology. This leads to a reduced threonine synthase activity without the threonine content in the plant being reduced. This technology is highly complex; the enzymatic activity must be inhibited in a very differentiated manner since otherwise auxotrophism for the amino acid occurs and the plant will no longer grow.

U.S. Pat. No. 5,589,616 teaches the production of higher amounts of amino acids in plants by overexpressing a monocot storage protein in dicots. WO 96/38574, WO 97/07665, WO 97/28247, U.S. Pat. No. 4,886,878, U.S. Pat. No. 5,082, 993 and U.S. Pat. No. 5,670,635 are following this approach. That means in all the aforementioned intellectual property rights different proteins or polypeptides are expressed in plants. Said proteins or polypeptides should function as amino acid sinks. Other methods for increasing amino acids such as lysine are disclosed in WO 95/15392, WO 96/38574, WO 89/11789 or WO 93/19190. In this cases speziell enzymes in the amino acid biosynthetic pathway such as the diphydrodipicolinic acid synthase are deregulated. This leads to an increase in the production of lysine in the different plants. Another approach to increase the level of amino acids in plants is disclosed in EP-A-0 271 408. EP-A-0 271 408 teaches the mutagenensis of plant and selection afterwards with inhibitors of certain enzymes of amino acid biosynthetic pathway.

Methods of recombinant DNA technology have also been used for some years to improve *Corynebacterium* strains producing L-amino acids by amplifying individual amino acid biosynthesis genes and investigating the effect on amino acid production.

As described above, the essential amino acids are necessary for humans and many mammals, for example for livestock. L-methionine is important as methyl group donor for the biosynthesis of, for example, choline, creatine, adrenaline, bases and RNA and DNA, histidine, and for the transmethylation following the formation of S-adenosylmethionine or as a sulfhydryl group donor for the formation of cysteine. Moreover, L-methionine appears to have a positive effect in depression.

Improving the quality of foodstuffs and animal feeds is an important task of the food-and-feed industry. This is necessary since, for example, certain amino acids, which occur in plants are limited with regard to the supply of mammals. Especially advantageous for the quality of foodstuffs and animal feeds is as balanced as possible an amino acid profile since a great excess of an amino acid above a specific concentration in the food has no further positive effect on the utilization of the food since other amino acids suddenly become limiting. A further increase in quality is only possible via addition of further amino acids, which are limiting under these conditions. The targeted addition of the limiting amino acid in the form of synthetic products must be carried out with extreme caution in order to avoid amino acid imbalance. For example, the addition of an essential amino acid stimulates protein digestion, which may cause deficiency situations for the second or third limiting amino acid, in particular. In feeding experiments, for example casein feeding experiments, the additional provision of methionine, which is limiting in casein, has revealed the fatty degeneration of liver, which could only be alleviated after the additional provision of tryptophan.

To ensure a high quality of foods and animal feeds, it is therefore necessary to add a plurality of amino acids in a balanced manner to suit the organism. Accordingly, there is still a great demand for new and more suitable genes, which encode enzymes or regulators, which participate in the biosynthesis of amino acids and make it possible to produce certain amino acids specifically on an industrial scale without unwanted byproducts forming. In the selection of genes for biosynthesis or regulation two characteristics above all are particularly important. On the one hand, there is as ever a need for improved processes for obtaining the highest possible contents of amino acids on the other hand as less as possible byproducts should be produced in the production process.

It is an object of the present invention to develop an inexpensive process for the synthesis of L-methionine. L-Methionine is with Lysin or threonine (depending on the organism) one of the two amino acids, which are most frequently limiting.

It was now found that this object is achieved by providing the process according to the invention described herein and the embodiments characterized in the claims.

Accordingly, in a first embodiment, the invention relates to a process for the production of a fine chemical, whereby the fine chemical is methionine. Accordingly, in the present invention, the term "the fine chemical" as used herein relates to "methione". Further, the term "the fine chemicals" as used herein also relates to fine chemicals comprising methionine.

In one embodiment, the term "the fine chemical" means L-methionine. Throughout the specification the term "the fine chemical" means L-methionine, its salts, ester or amids in free form or bound to proteins. In a preferred embodiment, the term "the fine chemical" means L-methionine in free form or its salts or bound to proteins.

Accordingly, the present invention relates to a process for the production of methionine, which comprises
a) increasing or generating the activity of a protein as shown in table II, application no. 1, column 3 encoded by the nucleic acid sequences as shown in table I, application no. 1, column 5, in an organelle of a microorganism or plant, or
b) increasing or generating the activity of a protein as shown in table II, application no. 1, column 3 encoded by the nucleic acid sequences as shown in table 1, application no. 1, column 5 in the plastid of a microorganism or plant, or in one or more parts thereof; and
c) growing the organism under conditions which permit the production of the fine chemical, thus, methionine or fine chemicals comprising methionine, in said organism or in the culture medium surrounding the organism.

In another embodiment the present invention is related to a process for the production of methionine, which comprises
a) increasing or generating the activity of a protein as shown in table II, application no. 1, column 3 encoded by the nucleic acid sequences as shown in table I, application no. 1, column 5, in an organelle of a non-human organism, or
b) increasing or generating the activity of a protein as shown in table II, application no. 1, column 3 encoded by the nucleic acid sequences as shown in table I, application no. 1, column 5, which are joined to a nucleic acid sequence encoding a transit peptide in a non-human organism, or in one or more parts thereof; or
c) increasing or generating the activity of a protein as shown in table II, application no. 1, column 3 encoded by the nucleic acid sequences as shown in table I, application no. 1, column 5, which are joined to a nucleic acid sequence encoding chloroplast localization sequence, in a non-human organism, or in one or more parts thereof, and
d) growing the organism under conditions which permit the production of methionine in said organism.

In another embodiment, the present invention relates to a process for the production of methionine, which comprises
a) increasing or generating the activity of a protein as shown in table II, application no. 1, column 3 encoded by the nucleic acid sequences as shown in table I, application no. 1, column 5, in an organelle of a microorganism or plant through the transformation of the organelle, or
b) increasing or generating the activity of a protein as shown in table II, application no. 1, column 3 encoded by the nucleic acid sequences as shown in table I, application no. 1, column 5 in the plastid of a microorganism or plant, or in one or more parts thereof through the transformation of the plastids; and
c) growing the organism under conditions which permit the production of the fine chemical, thus, methionine or fine chemicals comprising methionine, in said organism or in the culture medium surrounding the organism.

Advantageously the activity of the protein as shown in table II, application no. 1, column 3 encoded by the nucleic acid sequences as shown in table I, application no. 1, column 5 is increased or generated in the abovementioned process in the plastid of a microorganism or plant.

In principle the nucleic acid sequence encoding a transit peptide can be isolated from every organism such as microorganisms such as algae or plants containing plastids preferably chloroplasts. A "transit peptide" is an amino acid sequence, whose encoding nucleic acid sequence is translated together with the corresponding structural gene. That means the transit peptide is an integral part of the translated protein and forms an amino terminal extension of the protein. Both are translated as so called "preprotein". In general the transit peptide is cleaved off from the preprotein during or just after import of the protein into the correct cell organelle such as a plastid to yield the mature protein. The transit peptide ensures correct localization of the mature protein by facilitating the transport of proteins through intracellular membranes. Preferred nucleic acid sequences encoding a transit peptide are derived from a nucleic acid sequence encoding a protein finally resided in the plastid and stemming from an organism selected from the group consisting of the genera

*Acetabularia, Arabidopsis, Brassica, Capsicum, Chlamydomonas, Cururbita, Dunaliella, Euglena, Flaveria, Glycine, Helianthus, Hordeum, Lemna, Lolium, Lycopersion, Malus, Medicago, Mesembryanthemum, Nicotiana, Oenotherea, Oryza, Petunia, Phaseolus, Physcomitrella, Pinus, Pisum, Raphanus, Silene, Sinapis, Solanum, Spinacea, Stevia, Synechococcus, Triticum* and *Zea.*

Advantageously such transit peptides, which are beneficially used in the inventive process, are derived from the nucleic acid sequence encoding a protein selected from the group consisting of ribulose bisphosphate carboxylase/oxygenase, 5-enolpyruvyl-shikimate-3-phosphate synthase, acetolactate synthase, chloroplast ribosomal protein CS17, Cs protein, ferredoxin, plastocyanin, ribulose bisphosphate carboxylase activase, tryptophan synthase, acyl carrier protein, plastid chaperonin-60, cytochrome $C_{552}$, 22-kDA heat shock protein, 33-kDa Oxygen-evolving enhancer protein 1, ATP synthase γ subunit, ATP synthase δ subunit, chlorophyll-a/b-binding proteinII-1, Oxygen-evolving enhancer protein 2, Oxygen-evolving enhancer protein 3, photosystem I: P21, photosystem I: P28, photosystem I: P30, photosystem I: P35, photosystem I: P37, glycerol-3-phosphate acyltransferases, chlorophyll a/b binding protein, CAB2 protein, hydroxymethyl-bilane synthase, pyruvate-orthophosphate dikinase, CAB3 protein, plastid ferritin, ferritin, early light-inducible protein, glutamate-1-semialdehyde aminotransferase, protochlorophyllide reductase, starch-granule-bound amylase synthase, light-harvesting chlorophyll a/b-binding protein of photosystem II, major pollen allergen Lol p 5a, plastid ClpB ATP-dependent protease, superoxide dismutase, ferredoxin NADP oxidoreductase, 28-kDa ribonucleoprotein, 31-kDa ribonucleoprotein, 33-kDa ribonucleoprotein, acetolactate synthase, ATP synthase $CF_0$ subunit 1, ATP synthase $CF_0$ subunit 2, ATP synthase $CF_0$ subunit 3, ATP synthase $CF_0$ subunit 4, cytochrome f, ADP-glucose pyrophosphorylase, glutamine synthase, glutamine synthase 2, carbonic anhydrase, GapA protein, heat-shock-protein hsp21, phosphate translocator, plastid ClpA ATP-dependent protease, plastid ribosomal protein CL24, plastid ribosomal protein CL9, plastid ribosomal protein PsCL18, plastid ribosomal protein PsCL25, DAHP synthase, starch phosphorylase, root acyl carrier protein II, betaine-aldehyde dehydrogenase, GapB protein, glutamine synthetase 2, phosphoribulokinase, nitrite reductase, ribosomal protein L12, ribosomal protein L13, ribosomal protein L21, ribosomal protein L35, ribosomal protein L40, triose phosphate-3-phosphoglyerate-phosphate translocator, ferredoxin-dependent glutamate synthase, glyceraldehyde-3-phosphate dehydrogenase, NADP-dependent malic enzyme and NADP-malate dehydrogenase.

More preferred the nucleic acid sequence encoding a transit peptide is derived from a nucleic acid sequence encoding a protein finally resided in the plastid and stemming from an organism selected from the group consisting of the species:

*Acetabularia mediterranea, Arabidopsis thaliana, Brassica campestris, Brassica napus, Capsicum annuum, Chlamydomonas reinhardtii, Cururbita moschata, Dunaliella salina, Dunaliella tertiolecta, Euglena gracilis, Flaveria trinervia, Glycine max, Helianthus annuus, Hordeum vulgare, Lemna gibba, Lolium perenne, Lycopersion esculentum, Malus domestica, Medicago falcata, Medicago sativa, Mesembryanthemum crystallinum, Nicotiana plumbaginifolia, Nicotiana sylvestris, Nicotiana tabacum, Oenotherea hookeri, Oryza sativa, Petunia hybrida, Phaseolus vulgaris, Physcomitrella patens, Pinus tunbergii, Pisum sativum, Raphanus sativus, Silene pratensis, Sinapis alba, Solanum tuberosum, Spinacea oleracea, Stevia rebaudiana, Synechococcus, Synechocystis, Triticum aestivum* and *Zea mays.*

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 1, columns 5 and 7. Most preferred nucleic acid sequences encoding transit peptides are derived from the genus *Spinacia* such as chlorplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-tranlationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 1, column 3 and its homologs as disclosed in table I, application no. 1, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 1, column 3 and its homologs as disclosed in table I, application no. 1, columns 5 and 7.

The term "organelle" according to the invention shall mean for example "mitochondria" or preferably "plastid" (throughout the specification the "plural" shall comprise the "singular" and vice versa). The term "plastid" according to the invention are intended to include various forms of plastids including proplastids, chloroplasts, chromoplasts, gerontoplasts, leucoplasts, amyloplasts, elaioplasts and etioplasts preferably chloroplasts. They all have as a common ancestor the aforementioned proplasts.

Other transit peptides are disclosed by Schmidt et al. [J. Biol. Chem., Vol. 268, No. 36, 1993: 27447-27457], Della-Cioppa et al. [Plant. Physiol. 84, 1987: 965-968], de Castro Silva Filho et al. [Plant Mol. Biol., 30, 1996: 769-780], Zhao et al. [J. Biol. Chem. Vol. 270, No. 11, 1995: 6081-6087], Römer et al. [Biochem. Biophys. Res. Commun., Vol. 196, No. 3, 1993: 1414-1421], Keegstra et al. [Annu. Rev. Plant Physiol. Plant Mol. Biol., 40, 1989: 471-501], Lubben et al. [Photosynthesis Res., 17, 1988: 173-194] and Lawrence et al. [J. Biol. Chem., Vol. 272, No. 33, 1997: 20357-20363]. A general review about targeting is disclosed by Kermode Allison R. in Critical Reviews in Plant Science 15 (4): 285-423 (1996) under the title "Mechanisms of Intracellular Protein Transport and Targeting in Plant Cells."

Favored transit peptide sequences, which are used in the inventive process and which forms part of the inventive nucleic acid sequences are generally enriched in hydroxylated amino acid residues (serine and threonine), with these two residues generally constituting 20-35% of the total. They often have an amino-terminal region empty of Gly, Pro, and charged residues. Furthermore they have a number of small hydrophobic amino acids such as valine and alanine and generally acidic amino acids are lacking. In addition they generally have a middle region rich in Ser, Thr, Lys and Arg. Overall they have very often a net positive charge.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 1, columns 5 and 7. The person skilled in the art is able to join said sequences in a functional manner. Advantageously the transit peptide part is cleaved off from the protein part shown in table II, application no. 1, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein mentioned in table II, application no. 1, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 1, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 1, columns 5 and 7. Furthermore the skilled worker is aware of the fact that there is not a need for such short sequences in the expression of the genes.

TABLE V

Examples of transit peptides disclosed by von Heijne et al.

| Trans Pep | Organism | Transit Peptide | SEQ ID NO: | Reference |
|---|---|---|---|---|
| 1 | *Acetabularia mediterranea* | MASIMMNKSVVLSKECAKPLATPK VTLNKRGFATTIATKNREMMVWQP FNNKMFETFSFLPP | 14590 | Mol. Gen. Genet. 218:445-452 (1989) |
| 2 | *Arabidopsis thaliana* | MAASLQSTATFLQSAKIATAPSRG SSHLRSTQAVGKSFGLETSSARLT CSFQSDFKDFTGKCSDAVKIAGFA LATSALVVSGASAEGAPK | 14601 | EMBO J. 8:3187-3194 (1989) |

TABLE V-continued

Examples of transit peptides disclosed by von Heijne et al.

| Trans Pep | Organism | Transit Peptide | SEQ ID NO: | Reference |
|---|---|---|---|---|
| 3 | Arabidopsis thaliana | MAQVSRICNGVQNPSLICNLSKSS QRKSPLSVSLKTQQHPRAYPISSS WGLKKSGMTLIGSELRPLKVMSSV STAEKASEIVLQPIREISGLIKLP | 14602 | Mol. Gen. Genet. 210: 437-442 (1987) |
| 4 | Arabidopsis thaliana | MAAATTTTTSSSISFSTKPSPSS SKSPLPISRFSLPFSLNPNKSSSS SRRRGIKSSSP SS ISAVLNTTTNV TTTPSPTKPTKPETF ISRFAPDQP RKGA | 14603 | Plant Physiol. 85:1110-1117 (1987) |
| 5 | Arabidopsis thaliana | MITSSLTCSLQALKLSSPFAHGST PLSSLSKPNSFPNHRMPALVPV | 14604 | J. Biol. Chem. 2652763-2767 (1990) |
| 6 | Arabidopsis thaliana | MASLLGTSSSAIWASPSLSSPSSK PSSSPICFRPGKLFGSKLNAGIQI RPKKNRSRYHVSVMNVATEINSTE QVVGKFDSKKSARPVYPFAAI | 14605 | EMBO J. 9:1337-1346 (1990) |
| 7 | Arabidopsis thaliana | MASTALSSAIVGTSFIRRSPAPISL RSLPSANTQSLFGLKSGTARGG RVVAM | 14606 | Plant Physiol. 93: 572-577 (1990) |
| 8 | Arabidopsis thaliana | MAASTMALSSPAFAGKAVNLSPAA SEVLGSGRVTNRKTV | 14607 | Nucl. Acids Res. 14: 4051-4064 (1986) |
| 9 | Arabidopsis thaliana | MAAITSATVTIPSFTGLKLAVSSK PKTLSTISRSSSATRAPPKLALKS SLKDFGVIAVATAASIVLAGNAMA MEVLLGSDDGSLAFVPSEFT | 14608 | Gene 65: 59-69 (1988) |
| 10 | Arabidopsis thaliana | MAAAVSTVGAINRAPLSLNGSGSG AVSAPASTFLGKKVVTVSRFAQSN KKSNGSFKVLAVKEDKQTDGDRWR GLAYDTSDDQIDI | 14591 | Nucl. Acids Res. 17: 2871 (1989) |
| 11 | Arabidopsis thaliana | MkSSMLSSTAWTSPAQATMVAPF TGLKSSASFPVTRKANNDITSITS NGGRVSC | 14592 | Plant Mol. Biol. 11: 745-759 (1988) |
| 12 | Arabidopsis thaliana | MAASGTSATFRASVSSAPSSSSQL THLKSPFKAVKY TPLPS SRSKSSS FSVSCTIAKDPPVLMAAGSDPALW QRPDSFGRFGKFGGKYVPE | 14593 | Proc. Natl. Acad. Sci. USA, 86: 4604-4608 (1989) |
| 13 | Brassica campestris | MSTTFCSSVCMQATSLAATTRISF QKPALVSTTNLSFNLRRSIPTRFS ISCAAKPETVEKVSKIVKKQLSLK DDQKVVAE | 14594 | Nucl. Acids Res. 15: 7197 (1987) |
| 14 | Brassica napus | MATTFSASVSMQATSLATTTRISF QKPVLVSNHGRTNLSFNLSRTRLSISC | 14595 | Eur. J. Biochem. 174: 287-295 (1988) |
| 15 | Chlamydomonas reinhardtii | MQALSSRVNIAAKPQRAQRLVVRA EEVKAAPKKEVGPKRGSLVK | 14596 | Plant Mol. Biol. 12: 463-474 (1989) |
| 16 | Cucurbita moschata | MAELIQDKESAQSAATAAAASSGY ERRNEPAHSRKFLEVRSEEELLSCIKK | 14597 | FEBS Lett. 238: 424-430 (1988) |

TABLE V-continued

Examples of transit peptides disclosed by von Heijne et al.

| Trans Pep | Organism | Transit Peptide | SEQ ID NO: | Reference |
|---|---|---|---|---|
| 17 | Spinacea oleracea | MSTINGCLTSISPSRTQLKNTSTL RPTFIANSRVNPSSSVPPSLIRNQ PVFAAPAPIITPTL | 14598 | J. Biol. Chem. 265: 105414-5417 (1990) |
| 18 | Spinacea oleracea | MTTAVTAAVSFPSTKTTSLSARCS SVISPDKISYKKVPLYYRNVSATG KMGPIRAQIASDVEAPPPAPAKVEKMS | 14599 | Curr. Genet. 13: 517-522 (1988) |
| 19 | Spinacea oleracea | MTTAVTAAVSFPSTKTTSLSARSS SVISPDKISYKKVPLYYRNVSATG KMGPIRA | 14600 | |

Alternatively to the targeting of the sequences shown in table II, application no. 1, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 1, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

For expression a person skilled in the art is familiar with different methods to introduce the nucleic acid sequences into different organelles such as the preferred plastids. Such methods are for example disclosed by Pal Maiga (Annu. Rev. Plant Biol., 2004, 55: 289-313), Thomas Evans (WO 2004/040973), Kevin E. McBride et al. (U.S. Pat. No. 5,455,818), Henry Daniell et al. (U.S. Pat. No. 5,932,479 and U.S. Pat. No. 5,693,507) and Jeffrey M. Straub et al. (U.S. Pat. No. 6,781,033). A preferred method is the transformation of microspore-derived hypocotyl or cotyledonary tissue (which are green and thus contain numerous plastids) leaf tissue and afterwards the regeneration of shoots from said transformed plant material on selective medium. As methods for the transformation bombarding of the plant material or the use of independently replicating shuttle vectors are well known by the skilled worker. But also a PEG-mediated transformation of the plastids or Agrobacterium transformation with binary vectors are possible. Useful markers for the transformation of plastids are positive selection markers for example the chloramphenicol-, streptomycin-, kanamycin-, neomycin-, amikamycin-, spectinomycin-, triazine- and/or lincomycin-resistance genes. As additional markers named in the literature often as secondary markers, genes coding for the resistence against herbicides such as phosphinothricin (=glufosinate, BASTA™, Liberty™, encoded by the bar gene), glyphosate (=N-(phosphonomethyl)glycine, Roundup Ready™, encoded by the 5-enolpyruvylshikimaete-3-phosphate synthase gene=epsps), sulfonylurea (=Staple™, encoded by the acetolactate synthase gene), imidazolinone [=IMI, imazethapyr, imazamox, Clearfield™, encoded by the acetohydroxyacid synthase (AHAS) gene, also known as acetolactate synthase (ALS) gene] or bromoxynil (=Buctril™, encoded by the oxy gene) or genes coding for antibiotics such as hygromycin or G418 are useful for further selection. Such secondary markers are useful in the case when most genome copies are transformed. In addition negative selection markers such as the bacterial cytosine deaminase (encoded by the codA gene) are also useful for the transformation of plastids.

To increase the possibility of identification of transformants it is also diserable to use reporter genes other then the aforementioned resistance genes or in addition to said genes. Reporter genes are for example β-galactosidase-, β-glucuronidase-(GUS), alkaline phosphatase- and/or green-fluorescent protein-genes (GFP).

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 1, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 1, columns 5 and 7 or a sequence encoding a protein, as depicted in table II, application no. 1, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10):943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 1, columns 5 and 7 or a sequence encoding a protein, as depicted in table II, application no. 1, columns 5 and 7 in such a manner that the viroid sequence transports a sequence transcribed from a sequence as depicted in table I, application no. 1 columns 5 and 7 or a sequence encoding a protein as depicted in table II, application no. 1 columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 1, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 1, columns 5 and 7.

In a preferred embodiment of the invention the nucleic acid sequences as shown in table I, application no. 1, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 1, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

Comprises/comprising and grammatical variations thereof when used in this specification are to be taken to specify the presence of stated features, integers, steps or components or groups thereof, but not to preclude the presence or addition of one or more other features, integers, steps, components or groups thereof. The term "Table I" used in this specification is to be taken to specify the content of Table IA and Table IB. The term "Table II" used in this specification is to be taken to specify the content of Table IIA and Table IIB. The term "Table IA" used in this specification is to be taken to specify the content of Table IA. The term "Table IB" used in this specification is to be taken to specify the content of Table IB. The term "Table IIA" used in this specification is to be taken to specify the content of Table IIA. The term "Table IIB" used in this specification is to be taken to specify the content of Table IIB. In one preferred embodiment, the term "Table I" means Table IB. In one preferred embodiment, the term "Table II" means Table IIB.

Preferably, this process further comprises the step of recovering the fine chemical, which is synthesized by the organism from the organism and/or from the culture medium used for the growth or maintenance of the organism. The term "recovering" means the isolation of the fine chemical in different purities, that means on the one hand harvesting of the biological material, which contains the fine chemical without further purification and on the other hand purities of the fine chemical between 5% and 100% purity, preferred purities are in the range of 10% and 99%. In one embodiment, the purities are 20%, 30%, 40%, 50%, 60%, 70%, 80%, 90%, 95% or 99%.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 1, column 3. Preferably the modification of the activity of a protein as shown in table II, application no. 1, column 3 or their combination can be achieved by joining the protein to a transit peptide.

Surprisingly it was found, that the transgenic expression of the *Saccaromyces cerevisiae* protein as shown in table II, application no. 1, column 3 in plastids of a plant such as *Arabidopsis thaliana* for example through the linkage to at least one targeting sequence for example as mentioned in table V conferred an increase in the fine chemical content of the transformed plants.

In accordance with the invention, the term "organism" as understood herein relates always to a non-human organism, in particular to an animal or plant organism or to a microorganism. Further, the term "animal" as understood herein relates always to a non-human animal. Preferably the term "organism" shall mean a nonhuman organism such as a microorganism containing plastids such as algae or a plant.

The sequence of b2827 (Accession number PIR:SYECT) from *Escherichia coli* has been published in Blattner et al., Science 277 (5331), 1453-1474 (1997), and its activity is being defined as "thymidylate synthetase". Accordingly, in one embodiment, the process of the present invention comprises the use of a "thymidylate synthetase" or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a b2827 protein is increased or generated, e.g. from *Escherichia coli* or a homolog thereof, preferably linked at least to one transit peptide as mentioned for example in table V.

In another embodiment, in the process of the present invention the activity of a b2827 protein is increased or generated in a subcellular compartment of the organism or organism cell such as in an organelle like a plastid or mitochondria.

The sequence of YEL046C from *Saccharomyces cerevisiae* has been published in Dietrich et al., Nature 387 (6632 Suppl), 78-81 (1997) and Goffeau et al., Science 274 (5287), 546-547, 1996, and its activity is being defined as "L-threonine aldolase (Gly1p) that catalyzes cleavage of L-allo-threonine and L-threonine to glycine. Accordingly, in one embodiment, the process of the present invention comprises the use of a "L-threonine aldolase" or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a YEL046C protein is increased or generated, e.g. from *Saccharomyces cerevisiae* or a homolog thereof, preferably linked at least to one transit peptide as mentioned for example in table V. In another embodiment, in the process of the present invention the activity of a YEL046c protein is increased or generated in a subcellular compartment of the organism or organism cell such as in an organelle like a plastid or mitochondria.

The sequence of YGR255C from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "putative flavin-dependent monooxygenase" (Coq6p), which is involved in ubiquinone (Coenzyme Q) biosynthesis; located on the matrix side of the mitochondrial inner membrane. Accordingly, in one embodiment, the process of the present invention comprises the use of a "putative flavin-dependent monooxygenase" or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a putative flavin-dependent monooxygenase is increased or generated, e.g. from *Saccharomyces cerevisiae* or a homolog thereof, preferably linked at least to one transit peptide as mentioned for example in table V.

In another embodiment, in the process of the present invention the activity of a YGR255C protein is increased or generated in a subcellular compartment of the organism or organism cell such as in an organelle like a plastid or mitochondria.

The sequence of YGR289C from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "maltose permease" (Mal11p). Accordingly, in one embodiment, the process of the present invention comprises the use of a "maltose permease" or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a maltose permease is increased or generated, e.g. from *Saccharomyces cerevisiae* or a homolog thereof, preferably linked at least to one transit peptide as mentioned for example in table V.

In another embodiment, in the process of the present invention the activity of a YGR289C protein is increased or generated in a subcellular compartment of the organism or organism cell such as in an organelle like a plastid or mitochondria.

The sequence of YKR043C from *Saccharomyces cerevisiae* has been published in Goffeau et al., Science 274 (5287), 546-547 (1996) and Dujon et al., Nature 369 (6479), 371-378 (1994), and its activity has not being defined, It is a hypothetical ORF (Ykr043cp). Accordingly, in one embodiment, the process of the present invention comprises the use of a YKR043C protein or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a YKR043C protein is increased or generated, e.g. from *Saccharomyces cerevisiae* or a homolog thereof, preferably linked at least to one transit peptide as mentioned for example in table V.

In another embodiment, in the process of the present invention the activity of a YKR043C protein is increased or generated in a subcellular compartment of the organism or organism cell such as in an organelle like a plastid or mitochondria.

The sequence of YLR153C from *Saccharomyces cerevisiae* has been published in Johnston et al., Nature 387 (6632 Suppl), 87-90 (1997) and Goffeau et al., Science 274 (5287), 546-547, 1996, and its activity is being defined as a "acetyl-CoA synthetase" (Acs2p), which is involved in fatty acid biosynthesis. Accordingly, in one embodiment, the process of the present invention comprises the use of a "acetyl-CoA synthetase" or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a acetyl-CoA synthetase is increased or generated, e.g. from *Saccharomyces cerevisiae* or a homolog thereof, preferably linked at least to one transit peptide as mentioned for example in table V.

In another embodiment, in the process of the present invention the activity of a YLR153C protein is increased or generated in a subcellular compartment of the organism or organism cell such as in an organelle like a plastid or mitochondria.

In one embodiment, the homolog of the b2827 is a homolog having said activity and being derived from bacteria. In one embodiment, the homolog of the b2827 is a homolog having said activity and being derived from Proteobacteria. In one embodiment, the homolog of the b2827 is a homolog having said activity and being derived from Gammaproteobacteria. In one embodiment, the homolog of the b2827 is a homolog having said activity and being derived from Enterobacteriales. In one embodiment, the homolog of the b2827 is a homolog having said activity and being derived from Enterobacteriaceae. In one embodiment, the homolog of the b2827 is a homolog having said activity and being derived from *Escherichia*, preferably from *Escherichia coli*.

In one embodiment, the homolog of the YEL046C, YGR255C, YGR289C, YKR043C and/or YLR153C is a homolog having said activity and being derived from an eukaryotic. In one embodiment, the homolog of the YEL046C, YGR255C, YGR289C, YKR043C and/or YLR153C is a homolog having said activity and being derived from Fungi. In one embodiment, the homolog of the YEL046C, YGR255C, YGR289C, YKR043C and/or YLR153C is a homolog having said activity and being derived from Ascomyceta. In one embodiment, the homolog of the YEL046C, YGR255C, YGR289C, YKR043C and/or YLR153C is a homolog having said activity and being derived from *Saccharomycotina*. In one embodiment, the homolog of the YEL046C, YGR255C, YGR289C, YKR043C and/or YLR153C is a homolog having said activity and being derived from *Saccharomycetes*. In one embodiment, the homolog of the YEL046C, YGR255C, YGR289C, YKR043C and/or YLR153C is a homolog having said activity and being derived from *Saccharomycetales*. In one embodiment, the homolog of the YEL046C, YGR255C, YGR289C, YKR043C and/or YLR153C is a homolog having said activity and being derived from Saccharomycetaceae. In one embodiment, the homolog of the YEL046C, YGR255C, YGR289C, YKR043C and/or YLR153C is a homolog having said activity and being derived from *Saccharomycetes*.

Further homologs of the aforementioned proteins are described herein below.

In accordance with the invention, a protein or polypeptide has the "activity of an protein as shown in table II, application no. 1, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 1, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 1, column 3, or which has at least 10% of the original enzymatic activity, preferably 20%, particularly preferably 30%, most particularly preferably 40% in comparison to a protein as shown in table II, application no. 1, column 3 of *Saccharomyces cerevisiae*.

The terms "increased", "rised", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced.

The terms "increase" relate to a corresponding change of a property an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" include the change of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase is found cellular, thus the term "increase of an activity" or "increase of a metabolite content" relates to the cellular increase compared to the wild type cell.

Accordingly, the term "increase" means that the specific activity of an enzyme as well as the amount of a compound or metabolite, e.g. of a polypeptide, a nucleic acid molecule or of the fine chemical of the invention or an encoding mRNA or DNA, can be increased in a volume.

The terms "wild type", "control" or "reference" are exchangeable and can be a cell or a part of organisms such as an organelle like a chloroplast or a tissue, or an organism, in particular a microorganism or a plant, which was not modified or treated according to the herein described process according to the invention. Accordingly, the cell or a part of organisms such as an organelle like a chloroplast or a tissue, or an organism, in particular a microorganism or a plant used as wild typ, control or reference corresponds to the cell, organism or part thereof as much as possible and is in any other property but in the result of the process of the invention as identical to the subject matter of the invention as possible. Thus, the wild type, control or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or microorganism, which is nearly genetically identical to the organelle, cell, tissue or organism, in particular microorganism or plant, of the present invention or a part thereof preferably 95%, more preferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, which is genetically identical to the organism, cell or organelle used according to the process of the invention except that the responsible or activity conferring nucleic acid molecules or the gene product encoded by them are amended, manipulated, exchanged or introduced according to the inventive process.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 1, column 3 its biochemical or genetical causes and the increased amount of the fine chemical.

In case, a control, reference or wild type differing from the subject of the present invention only by not being subject of the process of the invention can not be provided, a control, reference or wild type can be an organism in which the cause for the modulation of an activity conferring the increase of the fine chemical or expression of the nucleic acid molecule of the invention as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or Protein or activity or expression of reference genes, like housekeeping genes, such as ubiquitin, actin or ribosomal proteins.

A series of mechanisms exists via which a modification of the a protein, e.g. the polypeptide of the invention can directly or indirectly affect the yield, production and/or production efficiency of the fine chemical.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 1, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

This also applies analogously to the combined increased expression of the nucleic acid molecule of the present invention or its gene product with that of further enzymes or regulators of the amino acid biosynthesis pathways, e.g. which are useful for the synthesis of the fine chemicals.

The increase or modulation according to this invention can be constitutive, e.g. due to a stable permanent transgenic expression or to a stable mutation in the corresponding endogenous gene encoding the nucleic acid molecule of the invention or to a modulation of the expression or of the behaviour of a gene conferring the expression of the polypeptide of the invention, or transient, e.g. due to an transient transformation or temporary addition of a modulator such as a agonist or antagonist or inducible, e.g. after transformation with a inducible construct carrying the nucleic acid molecule of the invention under control of a induceable promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, 300% or 400%, most preferably are to at least 500% or more in comparison to the control, reference or wild type. Preferably the increase in activity of the polypeptide amounts in an organelle such as a plastid.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the fine chemical level in comparison to a control is an easy test and can be performed as described in the state of the art.

The term "increase" includes, that a compound or an activity is introduced into a cell or a subcellular compartment or organelle de novo or that the compound or the activity has not been detectable before, in other words it is "generated".

Accordingly, in the following, the term "increasing" also comprises the term "generating" or "stimulating". The increased activity manifests itself in an increase of the fine chemical.

In case the activity of the *Escherichia coli* protein b2827 or its homologs, e.g. a "thymidylate synthetase" is increased advantageously in an organelle such as a plastid or mitochondria, preferably, in one embodiment an increase of the fine chemical, preferably of methionine between 47% and 51% or more is conferred.

In case the activity of the *Saccharomyces cerevisiae* protein YEL046C or its homologs, e.g. a "L-threonine aldolase" is increased advantageously in an organelle such as a plastid or mitochondria, preferably, in one embodiment an increase of the fine chemical, preferably of methionine between 70% and 328% or more is conferred.

In case the activity of the *Saccharomyces cerevisiae* protein YGR255C or its homologs, e.g. a "putative flavin-dependent monooxygenase" is increased advantageously in an organelle such as a plastid or mitochondria, preferably, in one embodiment an increase of the fine chemical, preferably of methionine between 36% and 292% or more is conferred.

In case the activity of the *Saccharomyces cerevisiae* protein YGR289C or its homologs, e.g. a "maltose permease" is increased advantageously in an organelle such as a plastid or mitochondria, preferably, in one embodiment the increase of the fine chemical, preferably of methionine between 24% and 36% or more is conferred.

In case the activity of the *Saccharomyces cerevisiae* protein YKR043C or its homologs, e.g. a "YKR043C protein activity" is increased, preferably, in one embodiment the increase of the fine chemical, preferably of methionine between 37% and 58% or more is conferred.

In case the activity of the *Saccharomyces cerevisiae* protein YLR153C or its homologs, e.g. a "acetyl-CoA synthetase" is increased advantageously in an organelle such as a plastid or mitochondria, preferably, in one embodiment the increase of the fine chemical, preferably of methionine between 29% and 117% or more is conferred.

In case the activity of the *Escherichia coli* proteins b2827 or its homologs," are increased advantageously in an organelle such as a plastid or mitochondria, preferably an increase of the fine chemical methionine is conferred.

In case the activity of the *Saccharomyces cerevisiae* protein YEL046C or its homologs e.g. a "L-threonine aldolase" is increased advantageously in an organelle such as a plastid or mitochondria, preferably an increase of the fine chemical and of proteins containing methionine is conferred.

In case the activity of the *Saccharomyces cerevisiae* protein YGR255C or its homologs, e.g. a putative flavin-dependent monooxygenase is increased advantageously in an organelle such as a plastid or mitochondria, preferably an increase of the fine chemical and of proteins containing methionine is conferred.

In case the activity of the *Saccharomyces cerevisiae* protein YGR289C or its homologs e.g. a "maltose permease" is increased advantageously in an organelle such as a plastid or mitochondria, preferably an increase of the fine chemical and of proteins containing methionine is conferred.

In case the activity of the *Saccharomyces cerevisiae* protein YKR043C or its homologs e.g. a "YKR043C protein" is increased advantageously in an organelle such as a plastid or mitochondria, preferably an increase of the fine chemical and of proteins containing methionine is conferred.

In case the activity of the *Saccharomyces cerevisiae* protein YLR153C or its homologs e.g. a "acetyl-CoA synthetase" is increased advantageously in an organelle such as a plastid or mitochondria, preferably an increase of the fine chemical and of proteins containing methionine is conferred.

In this context, the fine chemical amount in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

The fine chemical can be contained in the organism either in its free form and/or bound to proteins or polypeptides or mixtures thereof. Accordingly, in one embodiment, the amount of the free form in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%. Accordingly, in an other embodiment, the amount of the bound the fine chemical in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 1, column 7 or of the polypeptide as shown in the amino acid sequences as disclosed in table II, application no. 1, columns 5 and 7 or the functional homologues thereof as described herein, or is encoded by the nucleic acid molecule characterized herein or the nucleic acid molecule according to the invention, for example by the nucleic acid molecule as shown in table I, application no. 1, columns 5 and 7 or its herein described functional homologues and has the herein mentioned activity.

For the purposes of the present invention, the terms "L-methionine", "methionine", "homocysteine", "S-adenosylmethionine" and "threonine" also encompass the corresponding salts, such as, for example, methionine hydrochloride or methionine sulfate. Preferably the terms methionine is intended to encompass the term L-methionine.

Owing to the biological activity of the proteins which are used in the process according to the invention and which are encoded by nucleic acid molecules according to the invention, it is possible to produce compositions comprising the fine chemical, i.e. an increased amount of the free chemical free or bound, e.g. amino acid compositions. Depending on the choice of the organism used for the process according to the present invention, for example a microorganism or a plant, compositions or mixtures of various amino acids can be produced.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or organelles or time periods.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 1, columns 5 and 7 or its homologs activity having herein-mentioned methionine increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 1, columns 5 and 7, e.g. a nucleic acid sequence encoding a polypeptide having the activity of a protein as indicated in table II, application no. 1, columns 5 and 7 or its homologs or of a mRNA encoding the polypeptide of the present invention having herein-mentioned methionine increasing activity; and/or c) increasing the specific activity of a protein conferring the increased expression of a protein encoded by the nucleic acid molecule of the invention or of the polypeptide of the present invention having herein-mentioned methionine increasing activity, e.g. of a polypeptide having the activity of a protein as indicated in table II, application no. 1, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned methionine increasing activity, e.g. of a polypeptide having the activity of a protein as indicated in table II, application no. 1, columns 5 and 7 or its homologs; and/or e) stimulating activity of a protein conferring the increased expression of a protein encoded by the nucleic acid molecule of the present invention or a polypeptide of the present invention having herein-mentioned methionine increasing activity, e.g. of a polypeptide having the activity of a protein as indicated in table II, application no. 1, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned methionine increasing activity, e.g. of a polypeptide having the activity of a protein as indicated in table II, application no. 1, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned methionine increasing activity, e.g. of a polypeptide having the activity of a protein as indicated in table II, application no. 1, columns 5 and 7 or its homologs activity; and/or h) increasing the expression of the endogenous gene encoding the polypeptide of the invention, e.g. a polypeptide having the activity of a protein as indicated in table II, application no. 1, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned methionine increasing activity, e.g. of a polypeptide having the activity of a protein as indicated in table II, application no. 1, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned methionine increasing activity, e.g. of a polypeptide having the activity of a protein as indicated in table II, application no. 1, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of of the nucleic acids or polypeptides of the invention; and/or m) generating the expression of a protein encoded by the nucleic acid molecule of the invention or of the polypeptide of the present invention having herein-mentioned methionine increasing activity, e.g. of a polypeptide having the activity of a protein as indicated in table II, application no. 1, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 1, column 3 or its homologs. Preferably the increase of the fine chemical takes place in plastids.

In general, the amount of mRNA or polypeptide in a cell or a compartment of an organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in Textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren/Enzyme inhibitors".

The activity of the abovementioned proteins and/or polypeptide encoded by the nucleic acid molecule of the present invention can be increased in various ways. For example, the activity in an organism or in a part thereof, like a cell or in an organelle of the cell, is increased for example via targeting of the nucleic acid sequence or the encoded gene product to an organelle preferentially to plastids and/or increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention, e.g. as enzyme, can modulate the turn over rate of the enzyme, e.g. an exchange of an amino acid in the catalytic center can lead to an increased activity of the enzyme, or the deletion of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell or organelle of a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell or a cell compartment. "Increase" in the amount of a protein means the quantitative increase of the molecule number of said protein in an organism, a tissue, a cell or a cell compartment such as an organelle like a plastid or mitochondria or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable. Furthermore such an increase can be reached by the introduction of the inventive nucleic acid sequence or the encoded protein in the correct cell compartment for example into plastids either by transformation and/or targeting.

In one embodiment the increase in the amount of the fine chemical in the organism or a part thereof, e.g. in a cell, a tissue, an organ, an organelle etc., is achieved by increasing the endogenous level of the polypeptide of the invention. Accordingly, in an embodiment of the present invention, the present invention relates to a process wherein the gene copy number of a gene encoding the polynucleotide or nucleic acid molecule of the invention is increased. Further, the endogenous level of the polypeptide of the invention can for example be increased by modifying the transcriptional or translational regulation of the polypeptide.

In one embodiment the amount of the fine chemical in the organism or part thereof can be increase by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1): 174-84) and citations therein can be used to disrupt repressor elements or to enhance to activity of positive regulatory elements.

Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others cited therein. Reverse genetic strategies to identify insertions (which eventually carrying the activation elements) near in genes of interest have been described for various cases eg. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561 570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (eg T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is disrupted by the insertional mutagen.

The enhancement of positive regulatory elements or the disruption or weaking of negative regulatory elements can also be achieved through common mutagenesis techniques: The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce pointmutations that can be identified in any known gene using methods such as TILLING (Colbert et al. 2001). One can also envisage to introduce nucleic acids sequences, encoding plastidal targeting signals, like for example present in table V, by homologous recombination or other methods of site specific integration, into the genome in that way, that an endogenous gene is functionally fused to the targeting sequence and the protein is redirected to to the plastids. Eventually the integration can also occur randomly and the desired fusion event is selected for.

Accordingly, the expression level can be increased if the endogenous genes encoding a polypeptide conferring an increased expression of the polypeptide of the present invention, in particular genes comprising the nucleic acid molecule of the present invention, are modified via homologous recombination, Tilling approaches or gene conversion. It also possible to add as mentioned herein targeting sequences to the inventive nucleic acid sequences.

Regulatory sequences preferably in addition to a target sequence or part thereof can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended. For example, the activation of plant genes by random integrations of enhancer elements has been described by Hayashi et al., 1992 (Science 258:1350-1353) or Weigel et al., 2000 (Plant Physiol. 122, 1003-1013) and others cited therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, e.g. having the activity of a protein as shown in table II, application no. 1, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 1, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 1, column 3. The expression of the chimeric transcription factor in a organism, in particular in a plant, leads to a specific expression of the protein as shown in table II, application no. 1, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the process according to the invention, organisms are used in which one of the abovementioned genes, or one of the abovementioned nucleic acids, is mutated in a way that the activity of the encoded gene products is less influenced by cellular factors, or not at all, in comparison with the unmutated proteins. For example, well known regulation mechanism of enzymatic activity are substrate inhibition or feed back regulation mechanisms. Ways and techniques for the introduction of substitution, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specify activity or an increased activity per volume, in particular per cell.

It is therefore advantageously to express in an organism a nucleic acid molecule of the invention or a polypeptide of the invention derived from a evolutionary distantly related organism, as e.g. using a prokaryotic gene in a eukaryotic host, as in these cases the regulation mechanism of the host cell may not weaken the activity (cellular or specific) of the gene or its expression product The mutation is introduced in such a way that the production of the fine chemical is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to an increased productivity of the desired fine chemical(s).

Owing to the introduction of a gene or a plurality of genes conferring the expression of the nucleic acid molecule of the invention or the polypeptide of the invention, for example the nucleic acid construct mentioned below, or encoding the protein as shown in table II, application no. 1, column 3 into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutritional physiology limited) amino acids, like methionine, lysine or threonine alone or in combination in free or bound form.

Preferably the composition comprises further higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including amino acids, fatty acids, vitamins etc. or its precursors, required for the cell's biosynthesis of the fine chemical may be increased so that the concentration of necessary or relevant precursors, cofactors or intermediates within the cell(s) or within the corresponding storage compartments is increased. Owing to the increased or novel generated activity of the polypeptide of the invention or owing to the increased number of nucleic acid sequences of the invention and/or to the modulation of further genes which are involved in the biosynthesis of the fine chemical, e.g. by increasing the activity of enzymes synthesizing precursors or by destroying the activity of one or more genes which are involved in the breakdown of the fine chemical, it is possible to increase the yield, production and/or production efficiency of the fine chemical in the host organism, such as plants or the microorganisms.

By influencing the metabolism thus, it is possible to produce, in the process according to the invention, further advantageous sulfur-containing compounds, which contain at least one sulfur atom bound covalently. Examples of such compounds are, in addition to methionine, homocysteine, S-adenosylmethionine, cysteine, advantageously methionine and S-adenosylmethionine.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 1, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound amino acids, in particular methionine.

After the above-described increasing (which as defined above also encompasses the generating of an activity in an organism, i.e. a de novo activity), for example after the introduction and the expression of the nucleic acid molecules of the invention or described in the methods or processes according to the invention, the organism according to the invention, advantageously, a microorganism, a non-human animal, a plant, plant or animal tissue or plant or animal cell, is grown and subsequently harvested.

Suitable organisms or host organisms (transgenic organism) for the nucleic acid molecule used according to the invention and for the inventive process, the nucleic acid construct or the vector (both as described below) are, in principle, all organisms which are capable of synthesizing the fine chemical, and which are suitable for the activation, introduction or stimulation of recombinant genes. Examples which may be mentioned are transgenic plants, transgenic microorganisms such as fungi, bacteria, yeasts, alga or diatom preferably alga. Preferred organisms are those which are naturally capable of synthesizing the fine chemical in substantial amounts, like fungi, yeasts, bacteria or plants preferably alga and plants.

In the event that the transgenic organism is a microorganism, such as a eukaryotic organism, for example a fungus, an alga, diatom or a yeast in particular a fungus, alga, diatom or yeast selected from the families Tuberculariaceae, Adelotheciaceae, Dinophyceae, Ditrichaceae or Prasinophyceae. Preferred organisms are microorganisms such as green algae or plants. After the growing phase, the organisms can be harvested.

The organism, in particular the microorganism, plant or plant tissue is advantageously grown in such a way that it is not only possible to recover, if desired isolate the free or bound the fine chemical or the free and bound the fine chemical but as option it is also possible to produce, recover and, if desired isolate, other free or/and bound amino acids, in particular threonine and/or lysine. Galili et al., Transgenic Res., 200, 9, 2, 137-144 describes that the heterologous expression of a bacterial gene for the amino acid biosynthesis confers the increase of free as well as of protein-bound amino acids.

Preferred microorganisms are selected from the group consisting of Charophyceae such as the genera *Chara, Nitella* e.g. the species *Chara globularis, Chara vulgaris, Nitella flexilis,* Chlorophyceae such as the genera *Acrosiphonia, Spongomorpha, Urospora, Bryopsis, Pseudobryopsis, Trichosolen, Dichotomosiphon, Caulerpa, Rhipilia, Blastophysa, Avrainvillea, Chlorodesmis, Codium, Espera, Halicystis, Halimeda, Penicillus, Pseudocodium, Rhipiliopsis, Rhipocephalus, Tydemania, Udotea, Derbesia, Acrochaete, Aphanochaete, Bolbocoleon, Chaetobolus, Chaetonema, Chaetophora, Chlorotylium, Desmococcus, Draparnaldia, Draparnaldiopsis, Ectochaete, Endophyton, Entocladia, Epicladia, Internoretia, Microthamnion, Ochlochaete, Phaeophila, Pilinella, Pringsheimiella, Protoderma, Pseudendoclonium, Pseudodictyon, Pseudopringsheimia, Pseudulvella, Schizomeris, Stigeoclonium, Thamniochaete, Ulvella, Pilinia, Tellamia, Helicodictyon, Actidesmium, Ankyra, Characium, Codiolum, Sykidion, Keratococcus, Prototheca, Bracteacoccus Chlorococcum, Excentrosphaera, Hormidium, Oophila, Schroederia, Tetraedron, Trebouxia Chlorosarcinopsis, Gomphonitzschia, Coccomyxa, Dactylothece, Diógenes, Disporá, Gloeocystis, Mycanthococcus, Ourococcus, Coelastrum, Dicranochaete, Botryococcus, Dictyosphaerium, Dimorphococcus, Chlorochytrium, Kentrosphaera, Phyllobium, Gomontia, Hormotila, Euastropsis, Hydrodictyon, Pectodictyon, Pediastrum, Sorastrum, Tetrapedia, Acanthosphaera, Echinosphaerella, Echinosphaeridium, Errerella, Gloeoactinium, Golenkeniopsis Golenkinia, Micractinium, Ankistrodesmus, Chlorella, Chodatella, Closteriopsis, Cryocystis, Dactylococcus, Dematractum, Eremosphaera, Eutetramorus, Franceia, Glaucocystis, Gloeotaenium, Kirchneriella, Lagerheimiella, Monoraphidium, Nannochloris, Nephrochlamys, Nephrocytium, Oocystis, Oonephris, Pachycladon, Palmellococcus, Planktosphaeria, Polyedriopsis, Pseudoraciborskia, Quadrigula, Radiococcus, Rochiscia, Scotiella, Selanastrum, Thorakochloris, Treubaria, Trochiscia, Westella, Zoochlorella, Ostreobium, Phyllosiphon, Protosiphon, Rhodochytrium, Actinastrum, Coronastrum, Crucigenia, Dictymocystis, Enallax, Scenedesmus, Selenastrum, Tetradesmus, Tetrallantos, Tetrastrum, Chlorosarcina, Anadyomene, Valoniopsis, Ventricaria, Basicladia, Chaetomorpha, Cladophora, LolaPithophoraRhizoclonium Chaetosphaeridium, Conochaete, Coleochaete, Oligochaetophora, Polychaetophora, Cylindrocapsa, Gongrosira, Protococcus, Acetabularia, Batophora, Bornetella, Dasycladus, Halicoryne, Neomeris, Elakatothrix, Raphidonema, Microspora, Bulbochaete, Oedocladium, Oedogonium, Prasiola, Rosenvingiella, Schizogonium, Apjohnia, Chamaedoris, Cladophoropsis, Siphonocladus, Spongocladia, Boergesenia, Boodlea, Cystodictyon, Dictyosphaeria, Ernodesmis, Microdictyon, Struvea, Valonia, Sphaeroplea, Malleochloris, Stylosphaeridium, Gloeococcus, Palmella, Palmodictyon, Palmophyllum, Pseudospherocystis, Sphaerocystis, Urococcus, Apiocystis, Chaetopeltis, Gemellicystis, Paulschulzia, Phacomyxa, Pseudotetraspora, Schizochiamys, Tetraspora, Cephaleuros, Ctenocladus, Epibolium, Leptosira, Trentepohlia, Diplochaete, Monostroma, Binuclearia, Geminella, Klebsormidium, Planetonema, Radiofilum, Stichococcus, Ulothrix, Uronema, Blidingia, Capsosiphon, Chloropelta, Enteromorpha, Percursaria, Ulva, Ulvaria, Brachiomonas, Carteria, Chlainomonas, Chiamydomonas, Chlamydonephris, Chlorangium, Chlorogonium, Cyanidium, Fortiella, Glenomonas, Gloeomonas, Hyalogonium, Lobomonas Polytoma, Pyramichlamys, Scourfieldia, Smithsonimonas, Sphaerellopsis, Sphenochloris, Spirogonium, Collodictyon, Dunaliella, Haematococcus, Stephanosphaera, Coccomonas, Dysmorphococcus, Phacotus, Pteromonas, Thoracomonas, Wislouchiella, Mascherina, Pyrobotrys, Spondylomorum, Eudorina, Gonium, Oltmannsiella, Pandorina, Platydorina, Pleodorina, Stephanoon, Volvox, Volvulina, Actinotaenium, Arthrodesmus, Bambusina Closterium, Cosmarium, Desmidium, Euastrum, Groenbladia, Hyalotheca, Micrasterias, Penium, Phymatodocis, Pleurotaenium, Sphaerozosma, Spinoclosterium, Spinocosmarium, Spondylosium, Staurastrum, Tetmemorus, Triploceras, Xanthidium, Cylindrocystis, Genicularia, Gonatozygon, Mesotaenium, Netrium, Roya, Spirotaenia, Cosmocladium, Debarya, Docidium, Euastridium, Hallasia, Mougeotia, Mougeotiopsis, Sirogonium, Spirogyra, Staurodesmus, Teilingia, Zygnema, Zygogonium,* e.g. the species *Caulerpa taxifolia, Prototheca wickerhamii, Ankistrodesmus falcatus, Chlorella ellipsoidea, Chlorella pyrenoidosa, Clorella sorokiniana, Chlorella vulgaris, Scenedesmus obliquus, Scenedesmus quadricauda, Selenastrum capricornutum, Selenastrum undecimnotata, Cladophora glomerata, Chiamydomonas eugametos, Chlamydomonas reinhardtii, Cyanidium caldarium, Dunaliella salina, Dunaliella tertiolecta, Euglena gracilis, Haematococcus pluvialis,* Coniugatophyceae, Prasinophyceae Trebouxiophyceae, Ulvophyceae, Chlorodendraceae, Pedinomonadales, Halosphaeraceae, Pterospermataceae, Monomastigaceae, Pyramimonadaceae, Chlorodendraceae such as the genera *Prasinocladus* e.g. the species *Prasinocladus ascus,* Halosphaeraceae, Pedinomonadales, Pedinomonadaceae such as the genera *Pedinomonas,* Pterospermataceae such as the genera *Pachysphaera, Pterosperma, Halosphaera, Pyramimonas,* Bacillariophyceae, Chrysophyceae, Craspedophyceae, Euglenophyceae, Prymnesiophyceae, Phaeophyceae, Dinophyceae, Rhodophyceae, Xanthophyceae, Prasinophyceae such as the genera *Nephroselmis, Prasinococcus, Scherffelia, Tetraselmis, Mantoniella, Ostreococcus* e.g. the species *Nephroselmis olivacea, Prasinococcus capsulatus, Scherffelia dubia, Tetraselmis chui, Tetraselmis suecica, Mantoniella squamata* or *Ostreococcus tauri;*

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy],

*Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus columa* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomoea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta* [manihot, arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglansjamaicensis, Juglans major, Juglans microcarpa, Juglans nigra* or *Wallia nigra* [walnut, black walnut, common walnut, persian walnut, white walnut, butternut, black walnut]; Lauraceae such as the genera *Persea, Laurus* e.g. the species *laurel Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; *Palmae* such as the genera *Elacis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon., Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum* [Sorghum, millet], *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat], Proteaceae such as the genera *Macadamia* e.g. the species *Macadamia intergrifolia* [macadamia]; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum., Lycopersicon pyriforme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea].

All abovementioned organisms can be used as donor organism for the inventive nucleic acid sequences and/or can in principle also function as host organisms.

Particular preferred plants are plants selected from the group consisting of Asteraceae such as the genera *Helianthus, Tagetes* e.g. the species *Helianthus annus* [sunflower], *Tagetes lucida, Tagetes erecta* or *Tagetes tenuifolia* [Marigold], Brassicaceae such as the genera *Brassica, Arabadopsis* e.g. the species *Brassica napus, Brassica rapa* ssp. [canola, oilseed rape, turnip rape] or *Arabidopsis thaliana*. Fabaceae such as the genera *Glycine* e.g. the species *Glycine max, Soja hispida* or *Soja max* [soybean] (wobei ich nicht sicher bin, ob es Soja max überhaupt gibt, die heißt eigentlich *Glycine max*). Linaceae such as the genera *Linum* e.g. the species *Linum usitatissimum*, [flax, linseed]; Poaceae such as the genera *Hordeum, Secale, Avena, Sorghum, Oryza, Zea, Triticum* e.g. the species *Hordeum vulgare* [barley]; *Secale cereale* [rye], *Avena sativa, Avena fatua, Avena byzantina, Avena fatua* var. *sativa, Avena hybrida* [oat], *Sorghum bicolor [Sorghum, millet]*, *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat]; Solanaceae such as the genera *Solanum, Lycopersicon* e.g. the species *Solanum tuberosum* [potato], *Lycopersicon esculentum, Lycopersicon lycopersicum., Lycopersicon pyriforme, Solanum integrifolium* or *Solanum lycopersicum* [tomato].

All abovementioned organisms can in princible also function as host organisms.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table IA and/or IB, application no. 1, columns 5 and 7 or a derivative thereof, or
b) a genetic regulatory element, for example a promoter, which is functionally linked to the nucleic acid sequence as shown table IA and/or IB, application no. 1, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 1, columns 5 and 7 joined to a nucleic acid sequence encoding a transit peptide, or a targeting nucleic acid sequence which directs the nucleic acid sequences disclosed in table I, application no. 1, columns 5 and 7 to the organelle preferentially the plastids. Alternatively the inventive nucleic acids sequences consist advantageously of the nucleic acid sequences as depicted in the sequence protocol and disclosed in table I, application no. 1, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

The fine chemical, which is synthesized in the organism, in particular the microorganism, the cell, the tissue or the plant, of the invention can be isolated if desired. Depending on the use of the fine chemical, different purities resulting from the purification may be advantageous as will be described herein below.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine. After the activity of the protein as shown in table II, application no. 1, column 3 has been increased or generated in the cytsol or plastids, preferentially in the plastids, or after the expression of nucleic acid molecule or polypeptide according to the invention has been generated or increased, the transgenic plant generated thus is grown on or in a nutrient medium or else in the soil and subsequently harvested.

The plants or parts thereof, e.g. the leaves, roots, flowers, and/or stems and/or other harvestable material as described below, can then be used directly as foodstuffs or animal feeds or else be further processed. Again, the amino acids can be purified further in the customary manner via extraction and precipitation or via ion exchangers and other methods known to the person skilled in the art and described herein below. Products which are suitable for various applications and which result from these different processing procedures are amino acids or amino acid compositions which can still comprise further plant components in different amounts, advantageously in the range of from 0 to 99% by weight, preferably from below 90% by weight, especially preferably below 80% by weight. The plants can also advantageously be used directly without further processing, e.g. as feed or for extraction.

The chemically pure fine chemical or chemically pure compositions comprising the fine chemical may also be produced by the process described above. To this end, the fine chemical or the compositions are isolated in the known manner from an organism according to the invention, such as the microorganisms, non-human animal or the plants, and/or their culture medium in which or on which the organisms had been grown. These chemically pure fine chemical or said compositions are advantageous for applications in the field of the food industry, the cosmetics industry or the pharmaceutical industry.

Thus, the content of plant components and preferably also further impurities is as low as possible, and the abovementioned fine chemical is obtained in as pure form as possible. In these applications, the content of plant components advantageously amounts to less than 10%, preferably 1%, more preferably 0.1%, very especially preferably 0.01% or less.

Accordingly, the fine chemical produced by the present invention is at least 0.1% by weight pure, preferably more than 1% by weight pure, more preferred 10% by weight pure, even more preferred are more than 50, 60, 70 or 80% by weight purity, even more preferred are more than 90 weight-% purity, most preferred are 95% by weight, 99% by weight or more.

In this context, the amount of the fine chemical in a cell of the invention may be increased according to the process of the invention by at least a factor of 1.1, preferably at least a factor of 1.5; 2; or 5, especially preferably by at least a factor of 10 or 30, very especially preferably by at least a factor of 50, in comparison with the wild type, control or reference. Preferrably, said increase is found a tissue, more preferred in an organism or in a harvestable part thereof.

In principle, the fine chemicals produced can be increased in two ways by the process according to the invention. The pool of free fine chemicals, in particular of the free fine chemical, and/or the content of protein-bound fine chemicals, in particular of the protein-bound fine chemical may advantageously be increased.

It may be advantageous to increase the pool of free amino acids in the transgenic organisms by the process according to the invention in order to isolate high amounts of the pure fine chemical.

In another preferred embodiment of the invention a combination of the increased expression of the nucleic acid sequence or the protein of the invention together with the transformation of a protein or polypeptid, which functions as a sink for the desired amino acid for example methionine, lysine or threonine in the organism is useful to increase the production of the fine chemical (see U.S. Pat. No. 5,589,616, WO 96/38574, WO 97/07665, WO 97/28247, U.S. Pat. No. 4,886,878, U.S. Pat. No. 5,082,993 and U.S. Pat. No. 5,670, 635). Galili et al., Transgenic Res. 2000 showed, that enhancing the synthesis of threonine by a feed back insensitive aspertate kinase did not lead only to in increase in free threonine but also in protein bound threonine.

In may also be advantageous to increase the content of the protein-bound fine chemical.

In a preferred embodiment, the fine chemical (methionine) is produced in accordance with the invention and, if desired, is isolated. The production of further amino acids such as lysine, threonine etc. and of amino acid mixtures by the process according to the invention is advantageous.

In the case of the fermentation of microorganisms, the abovementioned fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. This concentrated fermentation broth can subsequently be processed by lyophilization, spray drying, spray granulation or by other methods.

To purify an amino acid, a product-containing fermentation broth from which the biomass has been separated may be subjected to chromatography with a suitable resin such as ion exchange resin for example anion or cation exchange resin, hydrophobic resin or hydrophilic resin for example epoxy resin, polyurethane resin or polyacrylamide resin, or resin for separation according to the molecular weight of the compounds for example polyvinyl chloride homopolymer resin or resins composed for example of polymers of acrylic acid, crosslinked with polyalkenyl ethers or divinyl glycol such as Carbopol®, Pemulen® and Noveon®. If necessary these chromatography steps may be repeated using the same or other chromatography resins. The skilled worker is familiar with the choice of suitable chromatography resins and their most effective use. The purified product may be concentrated by filtration or ultrafiltration and stored at a temperature, which ensures the maximum stability of the product.

The identity and purity of the compound(s) isolated can be determined by prior-art techniques. They encompass high-performance liquid chromatography (HPLC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, V C H Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Amino acids can for example be detected advantageously via HPLC separation in ethanolic extract as described by Geigenberger et al. (Plant Cell & Environ, 19, 1996: 43-55). Amino acids can be extracted with hot water. After filtration the extracts are diluted with water containing 20 mg/mL sodium acide. The separation and detection of the amino acids is performed using an anion exchange column and an electrochemical detector. Technical details can be taken from Y. Ding et al., 2002, Direct determination of free amino acids and sugars in green tea by anion-exchange chromatography with integrated pulsed amperometric detection, J Chromatogr A, (2002) 982; 237-244, or e.g. from Karchi et al., 1993, Plant J. 3: 721-727; Matthews MJ, 1997 (Lysine, threonine and methionine biosynthesis. In BK Singh, ed, Plant Amino Acids: Biochemistry and Biotechnology. Dekker, N.Y., pp 205-225; H Hesse and R Hoefgen. (2003) Molecular aspects of methionine biosynthesis. TIPS 8(259-262.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 1, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 1, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table III, application no. 1, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 1, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 1, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 1, columns 5 and 7 by one or more nucleotides. In one embodiment, the nucleic acid molecule used in the process of the invention does not consist of the sequence indicated in table IA, application no. 1, columns 5 and 7. In one embodiment, the nucleic acid molecule used in the process of the invention is less than 100%, 99.999%, 99.99%, 99.9% or 99% identical to a sequence indicated in Table IA, application no. 1, columns 5 and 7. In another embodiment, the nucleic acid molecule does not encode a polypeptide of a sequence indicated in table II A, application no. 1, columns 5 and 7.

In one embodiment, the nucleic acid molecule used in the process of the invention distinguishes over the sequence indicated in table IB, application no. 1, columns 5 and 7, by one or more nucleotides. In one embodiment, the nucleic acid molecule used in the process of the invention does not consist of the sequence indicated in table IB, application no. 1, columns 5 and 7. In one embodiment, the nucleic acid molecule used in the process of the invention is less than 100%, 99.999%, 99.99%, 99.9% or 99% identical to a sequence indicated in table IB, application no. 1, columns 5 and 7. In another embodiment, the nucleic acid molecule does not encode a polypeptide of a sequence indicated in table IIB, application no. 1, columns 5 and 7.

In one embodiment, the nucleic acid molecule used in the process distinguishes over the sequence shown in table I, application no. 1, columns 5 and 7 by one or more nucleotides or does not consist of the sequence shown in table I, application no. 1, columns 5 and 7. In one embodiment, the nucleic acid molecule of the present invention is less than 100%, 99.999%, 99.99%, 99.9% or 99% identical to the sequence shown in table I, application no. 1, columns 5 and 7. In another embodiment, the nucleic acid molecule does not encode a polypeptide of the sequence shown in table II, application no. 1, columns 5 and 7.

Unless otherwise specified, the terms "polynucleotides", "nucleic acid" and "nucleic acid molecule" as used herein are interchangeably. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence shown in table I, application no. 1, columns 5 and 7, nucleic acid molecules which are derived from the amino acid sequences shown in table II, application no. 1, columns 5 and 7 or from polypeptides comprising the consensus sequence shown in table IV, application no. 1, column 7, or their derivatives or homologues encoding polypeptides with the enzymatic or biological activity of a protein as shown in table II, application no. 1, column 3 or conferring the fine chemical increase after increasing its expression or activity are advantageously increased in the process according to the invention by expression either in the cytsol or in an organelle such as a plastid or mitochondria or both, preferably in plastids.

In one embodiment, said sequences are cloned into nucleic acid constructs, either individually or in combination. These nucleic acid constructs enable an optimal synthesis of the fine chemical produced in the process according to the invention.

Nucleic acid molecules, which are advantageous for the process according to the invention and which encode polypeptides with the activity of a protein as shown in table II, application no. 1, column 3 can be determined from generally accessible databases.

Those, which must be mentioned in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Cherry J. M. et al., Nucleic Acids Res. 1998, Vol. 26, 73-80) or the MIPS database (Mewes H. W. et al., Nucleic Acids Res. 1999, Vol. 27, 44-48), in the case of *E. coli* the GenProtEC database (http://web.bham.ac.uk/bcm4ght6/res.html), and in the case of *Arabidopsis* the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides with the activity of the proteins as shown in table II, application no. 1, column 3 and conferring the fine chemical increase by expression either in the cytsol or in an organelle such as a plastid or mitochondria or both, preferably in plastids.

The nucleic acid sequence(s) used in the process for the production of the fine chemical in transgenic organisms originate advantageously from an eukaryote but may also originate from a prokaryote or an archebacterium, thus it can derived from e.g. a microorganism, an animal or a plant such as the genera *Saccharomyces, Nostoc, Brucella, Yersinia, Salmonella, Escherichia, Caulobacter, Vibrio, Pseudomonas, Neisseria, Rickettsia, Xylella, Synechocystis, Schizosaccharomyces, Paramecium, Debaryomyces, Kluyveromyces, Erwinia, Acinetobacter, Candida, Bartonella, Yarrowia, Photobacterium, Rhodopseudomonas, Ashbya, Shigella, Photorhabdus, Chromobacterium, Rickettsia, Neurospora, Haemophilus, Nitrosomonas, Coxiella, Oryza, Xylella, Bradyrhizobium, Wigglesworthia, Synechococcus, Shewanella, Xanthomonas, Pasteurella, Gamma, Arabidopsis, Caenorhabditis, Drosophila, Homo sapiens, Mus musculus, Bacillus, Clostridium, Emericella, Aspergillus, Beta vulgaris, Amanita, Tetragenococcus, Pichia, Trichoderma, Equus caballus, Plantago, Mycobacterium, Orobanche, Prunus, Malus, Bacteroides, Staphylococcus, Zymomonas, Apium, Spinacia oleracea, Canis, Ovis*. The nucleic acid sequence encoding the transit peptide part of the inventive nucleic acid originates advantageously from a eukaryote such as a microorganism or a plant.

For the purposes of the invention, as a rule the plural is intended to encompass the singular and vice versa.

In order to improve the introduction of the nucleic acid sequences and the expression of the sequences in the transgenic organisms, which are used in the process, the nucleic acid sequences are incorporated into a nucleic acid construct and/or a vector. In addition to the herein described sequences which are used in the process according to the invention, further nucleic acid sequences, advantageously of biosynthesis genes of the fine chemical produced in the process according to the invention, may additionally be present in the nucleic acid construct or in the vector and may be introduced into the organism together. However, these additional sequences may also be introduced into the organisms via other, separate nucleic acid constructs or vectors.

Using the herein mentioned cloning vectors and transformation methods—such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant Physiol. Plant Molec. Biol. 42 (1991), 205-225)) and further cited below, the nucleic acids may be used for the recombinant modification of a wide range of organisms, in particular prokaryotic or eukaryotic microorganisms or plants, so that they become a better and more efficient producer of the fine chemical produced in the process according to the invention. This improved production, or production efficiency, of the fine chemical or products derived there from, such as modified proteins, can be brought about by a direct effect of the manipulation or by an indirect effect of this manipulation.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana,*

*Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot., Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeumjubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cemuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum., Lycopersicon pyriforme, Solanum integrifolium, Solanum lycopersicum Theobroma cacao* or *Camellia sinensis.*

In one embodiment, the nucleic acid molecule sequence originates advantageously from a microorganism as mentioned above under host organism such as a fungus for example the genera *Aspergillus, Penicillium* or *Claviceps* or from yeasts such as the genera *Pichia, Torulopsis, Hansenula, Schizosaccharomyces, Candida, Rhodotorula* or *Saccharomyces*, very especially advantageously from the yeast of the family Saccharomycetaceae, such as the advantageous genus *Saccharomyces* and the very advantageous genus and species *Saccharomyces cerevisiae* for the production of the fine chemical in microorganisms.

The skilled worker knows other suitable sources for the production of fine chemicals, which present also useful nucleic acid molecule sources. They include in general all prokaryotic or eukaryotic cells, preferably unicellular microorganisms, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula* or *Candida*. In addition advantageously algae or plants are used as source organism. The nucleic acid sequence encoding the transit peptide part of the inventive nucleic acid originates advantageously from a eukaryote such as a microorganism such as algae like for example Charophyceae, Chlorophyceae or Prasinophyceae or a plant.

Production strains which are especially advantageously selected in the process according to the invention are microorganisms such as algae selected from the group of the families Bacillariophyceae, Charophyceae, Chlorophyceae, Chrysophyceae, Craspedophyceae, Euglenophyceae, Prymnesiophyceae, Phaeophyceae, Dinophyceae, Rhodophyceae, Xanthophyceae, Prasinophyceae and its described species and strains.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 1, columns 5 and 7 or the functional homologues thereof as described herein, preferably conferring above-mentioned activity, i.e. conferring the fine chemical increase after increasing its activity, e.g. after increasing the activity of a protein as shown in table II, column 3 by for example expression either in the cytsol or in an organelle such as a plastid or mitochondria or both, preferably in plastids.

In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotide of the invention or of a part thereof can be isolated using molecular biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this very sequence. For example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as shown in table III, application no. 1, column 7, by means of polymerase chain reaction can be generated on the basis of a sequence shown herein, for example the sequence shown in table I, application no. 1, columns 5 and 7 or the sequences derived from table II, application no. 1, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 1, column 7 is derived from said alignments.

Degenerated primers can then be utilized by PCR for the amplification of fragments of novel proteins having abovementioned activity, e.g. conferring the increase of the fine chemical after increasing the expression or activity or having the activity of a protein as shown in table II, application no. 1, column 3 or further functional homologs of the polypeptide of the invention from other organisms.

These fragments can then be utilized as hybridization probe for isolating the complete gene sequence. As an alternative, the missing 5' and 3' sequences can be isolated by means of RACE-PCR. A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further informations about the expressed gene product: e.g. expression pattern, occurance of processing steps, like splicing and capping, etc. The Southern blot assay provides additional information about the chromosomal localization and organization of the gene encoding the nucleic acid molecule of the invention.

A preferred, nonlimiting example of stringent hydridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:RNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridzation with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some examples of conditions for DNA hybridization (Southern blot assays) and wash step are shown hereinbelow:
(1) Hybridization conditions can be selected, for example, from the following conditions:
  a) 4×SSC at 65° C.,
  b) 6×SSC at 45° C.,
  c) 6×SSC, 100 mg/ml denatured fragmented fish sperm DNA at 68° C.,
  d) 6×SSC, 0.5% SDS, 100 mg/ml denatured salmon sperm DNA at 68° C.,
  e) 6×SSC, 0.5% SDS, 100 mg/ml denatured fragmented salmon sperm DNA, 50% formamide at 42° C.,
  f) 50% formamide, 4×SSC at 42° C.,
  g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
  h) 2× or 4×SSC at 50° C. (low-stringency condition), or
  i) 30 to 40% formamide, 2× or 4×SSC at 42° C. (low-stringency condition).
(2) Wash steps can be selected, for example, from the following conditions:
  a) 0.015 M NaCl/0.0015 M sodium citrate/0.1% SDS at 50° C.
  b) 0.1×SSC at 65° C.
  c) 0.1×SSC, 0.5% SDS at 68° C.
  d) 0.1×SSC, 0.5% SDS, 50% formamide at 42° C.
  e) 0.2×SSC, 0.1% SDS at 42° C.
  f) 2×SSC at 65° C. (low-stringency condition).

Polypeptides having above-mentioned activity, i.e. conferring the fine chemical increase, derived from other organisms, can be encoded by other DNA sequences which hybridize to the sequences shown in table I, application no. 1, columns 5 and 7, preferably shown in table IB, application no. 1, columns 5 and 7 under relaxed hybridization conditions and which code on expression for peptides having the methionine increasing activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE, 0.1% SDS). The hybridisation analysis could reveal a simple pattern of only genes encoding polypeptides of the present invention or used in the process of the invention, e.g. having herein-mentioned activity of increasing the fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridizing with the nucleic acid molecule of the invention or used in the process of the invention under stringend conditions, while the maximum size is not critical. In some applications, the maximum size usually is not substantially greater than that required to provide the desired activity and/or function(s) of the original sequence.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinants. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and conferring above mentioned activity, preferably conferring an increase in the fine chemical.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 1, columns 5 and 7, preferably shown in table IB, application no. 1, columns 5 and 7 is one which is sufficiently complementary to one of the nucleotide sequences shown in table I, application no. 1, columns 5 and 7, preferably shown in table IB, application no. 1, columns 5 and 7 such that it can hybridize to one of the nucleotide sequences shown in table I, application no. 1, columns 5 and 7, preferably shown in Table IB, application no. 1, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 1, columns 5 and 7, preferably shown in table IB, application no. 1, columns 5 and 7, or a portion thereof and preferably has above mentioned activity, in particular having a fine chemical increasing activity after increasing the activity or an activity of a gene product as shown in table II, application no. 1, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 1, columns 5 and 7, preferably shown in table IB, application no. 1, columns 5 and 7, or a portion thereof and encodes a protein having above-mentioned activity, e.g. conferring of a methionine increase by for example expression either in the cytsol or in an organelle such as a plastid or mitochondria or both, preferably in plastids, and optionally, the activity of YEL046C, YGR255C, YGR289C, YKR043C and/or YLR153C.

Moreover, the nucleic acid molecule of the invention can comprise only a portion of the coding region of one of the sequences shown in table I, application no. 1, columns 5 and 7, preferably shown in table IB, application no. 1, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 1, columns 5 and 7, preferably shown in table IB, application no. 1, columns 5 and 7, an anti-sense sequence of one of the sequences, e.g., set forth in table I, application no. 1, columns 5 and 7, preferably shown in table IB, application no. 1, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 1, column 7 will result in a fragment of the gene product as shown in table II, column 3.

Primer sets are interchangable. The person skilled in the art knows to combine said primers to result in the desired product, e.g. in a full length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypeptide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the process of the present invention has been mutated or deleted.

The nucleic acid molecule of the invention encodes a polypeptide or portion thereof which includes an amino acid sequence which is sufficiently homologous to the amino acid sequence shown in table II, application no. 1, columns 5 and 7 such that the protein or portion thereof maintains the ability to participate in the fine chemical production, in particular a methionine increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 1, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 1, columns 5 and 7 and having above-mentioned activity, e.g. conferring preferably the increase of the fine chemical by for example expression either in the cytsol or in an organelle such as a plastid or mitochondria or both, preferably in plastids.

Portions of proteins encoded by the nucleic acid molecule of the invention are preferably biologically active, preferably having above-mentioned annotated activity, e.g. conferring an increase the fine chemical after increase of activity.

As mentioned herein, the term "biologically active portion" is intended to include a portion, e.g., a domain/motif, that confers increase of the fine chemical or has an immunological activity such that it is binds to an antibody binding specifically to the polypeptide of the present invention or a polypeptide used in the process of the present invention for producing the fine chemical.

The invention further relates to nucleic acid molecules that differ from one of the nucleotide sequences shown in table I, application no. 1, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 1, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 1, columns 5 and 7 or the functional homologues. In a still further embodiment, the nucleic acid molecule of the invention encodes a full length protein which is substantially homologous to an amino acid sequence shown in table II, application no. 1, columns 5 and 7 or the functional homologues. However, in a preferred embodiment, the nucleic acid molecule of the present invention does not consist of the sequence shown in table I, application no. 1, columns 5 and 7, preferably as indicated in table IA, application no. 1, columns 5 and 7. Preferably the nucleic acid molecule of the invention is a functional homologue or identical to a nucleic acid molecule indicated in table IB, application no. 1, columns 5 and 7.

In addition, it will be appreciated by those skilled in the art that DNA sequence polymorphisms that lead to changes in the amino acid sequences may exist within a population. Such genetic polymorphism in the gene encoding the polypeptide of the invention or comprising the nucleic acid molecule of the invention may exist among individuals within a population due to natural variation.

As used herein, the terms "gene" and "recombinant gene" refer to nucleic acid molecules comprising an open reading frame encoding the polypeptide of the invention or comprising the nucleic acid molecule of the invention or encoding the polypeptide used in the process of the present invention, preferably from a crop plant or from a microorganism useful for the production of fine chemicals, in particular for the production of the fine chemical. Such natural variations can typically result in 1-5% variance in the nucleotide sequence of the gene. Any and all such nucleotide variations and resulting amino acid polymorphisms in genes encoding a polypeptide of the invention or comprising a the nucleic acid molecule of the invention that are the result of natural variation and that do not alter the functional activity as described are intended to be within the scope of the invention.

Nucleic acid molecules corresponding to natural variants homologues of a nucleic acid molecule of the invention, which can also be a cDNA, can be isolated based on their homology to the nucleic acid molecules disclosed herein using the nucleic acid molecule of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 1, columns 5 and 7. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, nucleic acid molecule of the invention that hybridizes under stringent conditions to a sequence shown in table I, application no. 1, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having abovementioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. shown in table I, application no. 1, columns 5 and 7.

A "non-essential" amino acid residue is a residue that can be altered from the wild-type sequence of one without altering the activity of said polypeptide, whereas an "essential" amino acid residue is required for an activity as mentioned above, e.g. leading to an increase in the fine chemical in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organisms can differ. Therefore, he may adapt the codon usage in the nucleic acid molecule of the present invention to the usage of the organism or the cell compartment for example of the plastid or mitochondria in which the polynuclestide or polypeptide is expressed.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 1, columns 5 and 7, preferably shown in table IIA, application no. 1, columns 5 and 7 yet retain said activity described herein. The nucleic acid molecule can comprise a nucleotide sequence encoding a polypeptide, wherein the polypeptide comprises an amino acid sequence which is at least about 50% identical to an amino acid sequence shown in table II, application no. 1, columns 5 and 7, preferably shown in table IIA, application no. 1, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 1, columns 5 and 7, preferably shown in table IIA, application no. 1, columns 5 and 7, more preferably at least about 70% identical to one of the sequences shown in table II, application no. 1, columns 5 and 7, preferably shown in table IIA, application no. 1, columns 5 and 7, even more preferably at least about 80%, 90%, 95% homologous to the sequence shown in table II, application no. 1, columns 5 and 7, and most preferably at least about 96%, 97%, 98%, or 99% identical to the sequence shown in table II, application no. 1, columns 5 and 7, preferably shown in table IIA, application no. 1, columns 5 and 7.

To determine the percentage homology (=identity, herein used interchangeably) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTA Methods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the querry. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; q Penalty for a nucleotide mismatch (blastn only) [Integer]; default=−3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query define [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSITBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the perentages of sequence homology are done with the program Gap over the whole range of the sequences. The following standard adjustments for the comparison of nucleic acid sequences were used: gap weight: 50, length weight: 3, average match: 10.000, average mismatch: 0.000.

For example a sequence, which has 80% homology with sequence SEQ ID NO: 1 at the nucleic acid level is understood as meaning a sequence which, upon comparison with the sequence SEQ ID NO: 1 by the above Gap program algorithm with the above parameter set, has a 80% homology.

Homology between two polypeptides is understood as meaning the identity of the amino acid sequence over in each case the entire sequence length which is calculated by comparison with the aid of the program algorithm GAP (Wisconsin Package Version 10.0, University of Wisconsin, Genetics Computer Group (GCG), Madison, USA), setting the following parameters:

| Gap weight: | 8 | Length weight: | 2 |
| Average match: | 2,912 | Average mismatch: | −2,003 |

For example a sequence which has a 80% homology with sequence SEQ ID NO: 1 at the protein level is understood as meaning a sequence which, upon comparison with the sequence SEQ ID NO: 1 by the above program algorithm with the above parameter set, has a 80% homology.

Functional equivalents derived from one of the polypeptides as shown in table II, application no. 1, columns 5 and 7, preferably shown in table IIB, application no. 1, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 1, columns 5 and 7, preferably shown in table IIB, application no. 1, columns 5 and 7 resp., according to the invention and are distinguished by essentially the same properties as the polypeptide as shown in table II, application no. 1, columns 5 and 7, preferably shown in table IIB, application no. 1, columns 5 and 7.

Functional equivalents derived from the nucleic acid sequence as shown in table I, application no. 1, columns 5 and 7, preferably shown in table IB, application no. 1, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 1, columns 5 and 7, preferably shown in table IIB, application no. 1, columns 5 and 7 resp., according to the invention and encode polypeptides having essentially the same properties as the polypeptide as shown in table II, application no. 1, columns 5 and 7, preferably shown in table IIB, application no. 1, columns 5 and 7.

"Essentially the same properties" of a functional equivalent is above all understood as meaning that the functional equivalent has above mentioned activity, e.g. conferring an increasing in the fine chemical amount by for example expression either in the cytsol or in an organelle such as a plastid or mitochondria or both, preferably in plastids while increasing the amount of protein, activity or function of said functional equivalent in an organism, e.g. a microorgansm, a plant or plant or animal tissue, plant or animal cells or a part of the same.

A nucleic acid molecule encoding an homologous to a protein sequence of table II, application no. 1, columns 5 and 7, preferably shown in table IIB, application no. 1, columns 5 and 7 resp., can be created by introducing one or more nucleotide substitutions, additions or deletions into a nucleotide sequence of the nucleic acid molecule of the present invention, in particular of table I, application no. 1, columns 5 and 7, preferably shown in table IB, application no. 1, columns 5 and 7 resp., such that one or more amino acid substitutions, additions or deletions are introduced into the encoded protein. Mutations can be introduced into the encoding sequences of table I, application no. 1, columns 5 and 7, preferably shown in table IB, application no. 1, columns 5 and 7 resp., by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophane), beta-branched side chains (e.g., threonine, valine, isoleucine) and aromatic side chains (e.g., tyrosine, phenylalanine, tryptophane, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an increase in content of the fine chemical.

Following mutagenesis of one of the sequences of shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with the sequence shown in table I, application no. 1, columns 5 and 7, preferably shown in table IB, application no. 1, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 1, columns 5 and 7, preferably shown in table IB, application no. 1, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 1, columns 5 and 7, preferably shown in table IB, application no. 1, columns 5 and 7. It is preferred that the nucleic acid molecule comprises as little as possible other nucleotides not shown in any one of table I, application no. 1, columns 5 and 7, preferably shown in table IB, application no. 1, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 1, columns 5 and 7, preferably shown in table IB, application no. 1, columns 5 and 7.

Also preferred is that the nucleic acid molecule used in the process of the invention encodes a polypeptide comprising the sequence shown in table II, application no. 1, columns 5 and 7, preferably shown in table IIB, application no. 1, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 1, columns 5 and 7, preferably shown in table IIB, application no. 1, columns 5 and 7.

In one embodiment, the nucleic acid molecule of the invention or used in the process encodes a polypeptide comprising the sequence shown in table II, application no. 1, columns 5 and 7, preferably shown in table IIB, application no. 1, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 1, columns 5 and 7, preferably shown in table IB, application no. 1, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 1, columns 5 and 7 expressed under identical conditions.

Homologues of table I, application no. 1, columns 5 and 7 or of the derived sequences of table II, application no. 1, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In a further embodiment, the process according to the present invention comprises the following steps:
(a) selecting an organism or a part thereof expressing the polypeptide of this invention in the cytsol and/or in an organelle such as a plastid or mitochondria, preferably in a plastid;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise an increased activity or expression level of said polypeptide compared to the selected organism (a) or the part thereof;
(e) optionally, growing and cultivating the organisms or the parts thereof; and
(f) recovering, and optionally isolating, the free or bound the fine chemical produced by the selected mutated organisms or parts thereof.

The organisms or part thereof produce according to the herein mentioned process of the invention an increased level of free and/or bound fine chemical compared to said control or selected organisms or parts thereof.

Advantageously the seclected organisms are mutagenized according to the invention. According to the invention mutagenesis is any change of the genetic information in the genom of an organism, that means any structural or compositional change in the nucleic acid preferably DNA of an organism that is not caused by normal segregation or genetic recombination processes. Such mutations may occur spontaneously, or may be induced by mutagens as described below. Such change can be induced either randomly or selectively. In both cases the genetic information of the organism is modified. In general this lead to the situation that the activity of the gene product of the relevant genes inside the cells or inside the organism is increased.

In case of the specific or so called site directed mutagenesis a distinct gen is mutated and thereby its activity and/or the activity or the encoded gene product is repressed, reduced or increased, preferably increased. In the event of a random mutagenesis one or more genes are mutated by chance and their activities and/or the activities of their gen products are repressed, reduced or increased, preferably increased.

For the purpose of a mutagenesis of a huge population of organisms, such population can be transformed with a DNA construct, which is useful for the activation of as much as possible genes of an organism, preferably all genes. For example the construct can contain a strong promoter or one or more enhancers, which are capable of transcriptionally activate genes in the vicinity of their integration side. With this method it is possible to statistically mutagenize, e.g. activate nearly all genes of an organism by the random integration of an activation construct. Afterwards the skilled worker can identify those mutagenized lines in which a gene of the invention has been activated, which in turns leads to the desired increase in the fine chemical production.

The genes of the invention can also be activated by mutagensis, either of regulatory or coding regions. In the event of a random mutagenesis a huge number of organisms are treated with a mutagenic agent. The amount of said agent and the intensity of the treatment would be chosen in such a manner that statistically nearly every gene be mutated once. The process for the random mutagensis as well as the respective agents is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000) "Protocols in Mutagenesis", Elsevier Health Sciences]. As the skilled worker knows the spontaneous mutation rate in the cells of an organism is very low and that a large numer of chemical, physical or biological agents are available for the mutagenesis of organisms. These agents are named as mutagens or mutagenic agents. As mentioned before three different kinds of mutagens (chemical, physical or biological agents) are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate, dimethylsulfate, methyl methanesulfonate), bifunctional like dichloroethyl sulphide, Mitomycin, Nitrosoguanidine-dialkylnitrosamine, N-Nitrosoguanidin derivatives, N-alkyl-N-nitro-N-nitroso-guanidine-), intercalating dyes like Acridine, ethidium bromide).

Physical mutagens are for example ionizing irradiation (X ray), UV irradiation. Different forms of irradiation are available and they are strong mutagens. Two main classes of irradiation can be distinguished: a) non-ionizing irradiation such as UV light or ionizing irradiation such as X ray. Biological mutagens are for example transposable elements for example IS elements such as IS100, transposons such as Tn5, Tn10, Tn916 or Tn1000 or phages like Mu$^{amplac}$, P1, T5, Aplac etc. Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art.

Preferably a chemical or biochemical procedure is used for the mutagenesis of the organisms. A preferred chemical method is the mutagensis with N-methyl-N-nitro-nitrosoguanidine.

Other biological methods are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a paranitrobenzyl ester. Another route to the mutagenesis of enzymes is described by Greener et al. in Methods in Molecular Biology (Vol. 57, 1996: 375-385). Greener et al. use the specific *Escherichia coli* strain XL1-Red to generate *Escherichia coli* mutants which have increased antibiotic resistance.

In one embodiment, the protein according to the invention or the nucleic acid molecule characterized herein originates from a eukaryotic or prokaryotic organism such as a non-human animal, a plant, a microorganism such as a fungus, yeast, an alga, a diatom or a bacterium. Nucleic acid molecules, which advantageously can be used in the process of the invention originate from yeasts, for example the family Saccharomycetaceae, in particular the genus *Saccharomyces*, or yeast genera such as *Candida, Hansenula, Pichia, Yarrowia, Rhodotorula* or *Schizosaccharomyces* and the especially advantageous from the species *Saccharomyces cerevisiae*.

If, in the process according to the invention, plants are selected as the donor organism, this plant may, in principle, be in any phylogenetic relation of the recipient plant. Donor and recipient plant may belong to the same family, genus, species, variety or line, resulting in an increasing homology between the nucleic acids to be integrated and corresponding parts of the genome of the recipient plant. This also applies analogously to microorganisms as donor and recipient organism.

It might also be advantageously to use nuclei acids molecules from very distinct species, since these might exhibit reduced sensitivity against endogenous regulatory mechanisms and such sequences might not be recognized by endogenous silencing mechanisms.

Accordingly, one embodiment of the application relates to the use of nucleic acid molecules in the process of the invention from algae or plants, e.g. crop plants, e.g. from: *B. napus; Glycine max; Oryza sativa*, sunflower linseed or maize or their homologues.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 1, columns 5 and 7, preferably shown in table IIB, application no. 1, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 1, columns 5 and 7, preferably shown in table IB, application no. 1, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 1, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 1, columns 7 and conferring an increase in the amount of the fine chemical in an organism or a part thereof;

k) nucleic acid molecule encoding the amino acid sequence of a polypeptide encoding a domain of the polypeptide shown in table II, application no. 1, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 1, columns 5 and 7 or a nucleic acid molecule encoding, preferably at least the mature form of, the polypeptide shown in table II, application no. 1, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 1, columns 5 and 7 by one or more nucleotides. In one embodiment, the nucleic acid molecule of the invention does not consist of the sequence shown in table IA and/or IB, application no. 1, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 1, columns 5 and 7. In a further embodiment the nucleic acid molecule does not encode the polypeptide sequence shown in table IIA and/or IIB, application no. 1, columns 5 and 7. Accordingly, in one embodiment, the nucleic acid molecule of the present invention encodes in one embodiment a polypeptide which differs at least in one or more amino acids from the polypeptide shown in table II, application no. 1, columns 5 and 7 does not encode a protein of the sequence shown in table IIA and/or IIB, application no. 1, columns 5 and 7. Accordingly, in one embodiment, the protein encoded by a sequence of a nucleic acid according to (a) to (l) does not consist of the sequence shown in table IA and/or IB, application no. 1, columns 5 and 7. In a further embodiment, the protein of the present invention is at least 30% identical to protein sequence depicted in table IIA and/or IIB, application no. 1, columns 5 and 7 and less than 100%, preferably less than 99.999%, 99.99% or 99.9%, more preferably less than 99%, 985, 97%, 96% or 95% identical to the sequence shown in table IIA and/or IIB, application no. 1, columns 5 and 7.

The nucleic acid sequence according to the invention mentioned above is advantageously functionally joined to a nucleic acid sequence encoding a transit peptide, in such a manner that a preprotein is translated, which is able to direct the polypeptide to the organelle such as to the plastid. In another preferred embodiment the nucleic acids according to the invention mentioned above is advantageously functionally joined to a promotor region functional in plastids like for example the RNA operon promoter fused to the 5'UTR of the rbcL gene and in another preferred embodiment joined to a plastome sequences homologous to the integration sites. Example for useful integration sites are the trnV-rps12/7 (Skidar et al., Plant Cell Rep. 1998, 18: 20-24 and other reports), thr rbvL-aacD site (Svab et al. 1993, Proc. Natl. Acad. Sci. USA 90: 913-917), the trnI-trnA site (De Cosa et al., 2001, Nat. Biotech. 19, 71-74) the rps7-ndhB site (Hou et al., 2003, Transgenic Res. 12, 111-114) and the ndhF-tmL site Zhang et al., 2001c, Plant Physiol. 127, 131-141)

The nucleic acid sequence coding for the transit peptide is advantageously derived from a nucleic acid sequence encoding a protein finally resided in the plastid and is stemming from an organism selected from the group consisting of the Genera
*Acetabularia, Arabidopsis, Brassica, Chlamydomonas, Cururbita, Dunaliella, Euglena, Flaveria, Glycine, Helianthus, Hordeum, Lemna, Lolium, Lycopersion, Malus, Mesembryanthemum, Nicotiana, Oenotherea, Oryza, Petunia, Phaseolus, Physcomitrella, Pinus, Pisum Raphanus, Silene, Sinapis, Solanum, Spinacea, Triticum* and *Zea.*

Preferably the transit peptide is derived from a protein selected from the group consisting of
ribulose bisphosphate carboxylase/oxygenase, 5-enolpyruvyl-shikimate-3-phosphate synthase, acetolactate synthase, chloroplast ribosomal protein CS17, Cs protein, ferredoxin, plastocyanin, ribulose bisphosphate carboxylase activase, tryptophan synthase, acyl carrier protein, plastid chaperonin-60, cytochrome $c_{552}$, 22-kDA heat shock protein, 33-kDa Oxygen-evolving enhancer protein 1, ATP synthase γ subunit, ATP synthase δ subunit, chlorophyll-a/b-binding proteinil-1, Oxygen-evolving enhancer protein 2, Oxygen-evolving enhancer protein 3, photosystem I: P21, photosystem I: P28, photosystem I: P30, photosystem I: P35, photosystem I: P37, glycerol-3-phosphate acyltransferases, chlorophyll a/b binding protein, CAB2 protein, hydroxymethyl-bilane synthase, pyruvate-orthophosphate dikinase, CAB3 protein, plastid ferritin, ferritin, early light-inducible protein, glutamate-1-semialdehyde aminotransferase, protochlorophyllide reductase, starch-granule-bound amylase synthase, light-harvesting chlorophyll a/b-binding protein of photosystem 11, major pollen allergen Lol p 5a, plastid ClpB ATP-dependent protease, superoxide dismutase, ferredoxin NADP oxidoreductase, 28-kDa ribonucleoprotein, 31-kDa ribonucleoprotein, 33-kDa ribonucleoprotein, acetolactate synthase, ATP synthase $CF_0$ subunit 1, ATP synthase $CF_0$ subunit 2, ATP synthase $CF_0$ subunit 3, ATP synthase $CF_0$ subunit 4, cytochrome f, ADP-glucose pyrophosphorylase, glutamine synthase, glutamine synthase 2, carbonic anhydrase, GapA protein, heat-shock-protein hsp21, phosphate translocator, plastid ClpA ATP-dependent protease, plastid ribosomal protein CL24, plastid ribosomal protein CL9, plastid ribosomal protein PsCL18, plastid ribosomal protein PsCL25, DAHP synthase, starch phosphorylase, root acyl carrier protein 11, betaine-aldehyde dehydrogenase, GapB protein, glutamine synthetase 2, phosphoribulokinase, nitrite reductase, ribosomal protein L12, ribosomal protein L13, ribosomal protein L21, ribosomal protein L35, ribosomal protein L40, triose phosphate-3-phosphoglyerate-phosphate translocator, ferredoxin-dependent glutamate synthase, glyceraldehyde-3-phosphate dehydrogenase, NADP-dependent malic enzyme and NADP-malate dehydrogenase. The plastome sequences are preferential derived from the plastome of the target organisms themselves and are advantageously derived from one of the following intergration sites: trnV-rps12/7 (Skidar et al., Plant Cell Rep. 1998, 18: 20-24 and other reports), rbvL-aacD (Svab et al. 1993, Proc. Natl. Acad. Sci. USA 90: 913-917), trnI-trnA (De Cosa et al., 2001, Nat. Biotech. 19, 71-74) rps7-ndhB (Hou et al., 2003, Transgenic Res. 12, 111-114) or ndhF-trnL site Zhang et al., 2001c, Plant Physiol. 127, 131-141).

The nucleic acid sequences used in the process are advantageously introduced in a nucleic acid construct, preferably an expression cassette, which makes possible the expression of the nucleic acid molecules in an organism, advantageously a plant or a microorganism such as an algae, advantageously in the plastids of those organisms.

Accordingly, the invention also relates to a nucleic acid construct, preferably to an expression construct, comprising the nucleic acid molecule of the present invention functionally linked to one or more regulatory elements or signals.

As described herein, the nucleic acid construct can also comprise further genes, which are to be introduced into the organisms or cells. It is possible and advantageous to introduce into, and express in, the host organisms regulatory genes such as genes for inductors, repressors or enzymes, which, owing to their enzymatic activity, engage in the regulation of one or more genes of a biosynthetic pathway. These genes can be of heterologous or homologous origin. Moreover, further biosynthesis genes may advantageously be present, or else these genes may be located on one or more further nucleic acid constructs. Genes, which are advantageously employed as biosynthesis genes are genes of the fatty acid metabolism, amino acid metabolism, of glycolysis, of the tricarboxylic acid metabolism or their combinations. As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing mRNA stability or by inserting a translation enhancer sequence.

In principle, the nucleic acid construct can comprise the herein described regulator sequences and further sequences relevant for the expression of the comprised genes. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both. In another embodiment the expression cassette encompasses sequences for transcription by plastid RNA polymerases.

Accordingly, in one embodiment, the process according to the invention comprises the following steps:
(a) introducing of a nucleic acid construct comprising the nucleic acid molecule of the invention or used in the process of the invention or encoding the polypeptide of the present invention or used in the process of the invention; or
(b) introducing of a nucleic acid molecule, including regulatory sequences or factors, which expression increases the expression of the nucleic acid molecule of the invention or used in the process of the invention or encoding the polypeptide of the present invention or used in the process of the invention;

in a cell, or an organism or a part thereof, preferably in a plant, plant cell or a microorganism preferably in the organelles such as the plastids thereof, and (c) expressing of the gene product encoded by the nucleic acid construct or the nucleic acid molecule mentioned under (a) or (b) in the cell or the organism or part thereof.

After the introduction and expression of the nucleic acid construct the transgenic organism or cell is advantageously cultured and subsequently harvested. The transgenic organism or cell is advantageously a eukaryotic organism such as a microorganism, a non-human animal or plant preferably a microorganism such as an algae or a plant such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae, preferably a crop or oilseed crop plant, or a part thereof.

To introduce a nucleic acid molecule into a nucleic acid construct, e.g. as part of an expression cassette, the codogenic gene segment is advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. The primers should expediently be chosen in such a way that the amplificate comprise the codogenic sequence from the start to the stop codon. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. The skilled worker generally knows suitable cloning vectors.

They include, in particular, vectors which are capable of replication in easy to handle cloning systems like as bacterial yeast or insect cell based (e.g. baculovirus expression) systems, that is to say especially vectors which ensure efficient cloning in *E. coli*, and which make possible the stable transformation of plants. Vectors, which must be mentioned, in particular are various binary and cointegrated vector systems, which are suitable for the T-DNA-mediated transformation. Such vector systems are generally characterized in that they contain at least the vir genes, which are required for the *Agrobacterium*-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 1, columns 5 and 7 can be cloned 3' prime to the transitpeptide encoding sequence, leading to a functional preprotein, which is directed to the plastids and which means that the mature protein fulfills its biological activity.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly prepared vector fragments, using ligase. In this context, a specific nucleic acid construct, or vector or plasmid construct, may have one or else more codogenic gene segments. The codogenic gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector: Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. or other prokaryotic regulatory sequences for the transfer into other prokaryotic cells, e.g. *Corynebacterium* sp. or *Bacillus* sp. For the transformation of plants, the right border sequence, which comprises approximately 25 base pairs, of the total agrobacterial T-DNA sequence is advantageously included. Usually, the plant transformation vector constructs according to the invention contain T-DNA sequences both from the right and from the left border region, which contain expedient recognition sites for site-specific acting enzymes, which, in turn, are encoded by some of the vir genes.

Alternatively the nuleic acids of the invention are cloned into vectors, which are designed for the direct transformation of organelles such as plastids. Generally such vectors additionally carry a specific resistance gene (as mentioned above), like the spectomycin resistance gene (aad) under control of a plastid regulatory sequence and two adjacent plastome sequences of the target organism, which mediated the directed insertion of the sequences of interest, e.g. the resistance gene and the expression cassette, into the plastidal genome through homologous recombination. As transformation can be achieved by particle bombardment or other physical or chemical methods e.g. PEG treatment or microinjection, the vectors do not need to contain the elements necessary for agrobacterial T-DNA transfer (see below).

Suitable host organisms are known to the skilled worker. Advantageous organisms are described further above in the present application. They include in particular eukaryotes such as microorganisms and plants. Other useful organisms are prokaryotic host organisms, which may be useful for the cloning of desired nucleic acid constructs or vectors such as the genera *Escherichia* for example the species *Escherichia coli*, specifically *Escherichia coli* K12 and its described strains or *Agrobacterium* for example the species *Agrobacterium tumefaciens*.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and lucerne.

In order to introduce, into a plant, the nucleic acid molecule of the invention or used in the process according to the invention, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. As a rule, universal primers which are derived from vector sequences are used for this purpose, it being possible, for example, for a forward primer to be arranged upstream of the start ATG and a reverse primer to be arranged downstream of the stop codon of the codogenic gene segment. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

The nucleic acid molecule of the invention or used in the process according to the invention can also be introduced into modified viral vectors like baculovirus vectors for expression in insect cells or plant viral vectors like tobacco mosaic virus or potato virus X-based vectors. Approaches leading to the expression of proteins from the modified viral genome including the nucleic acid molecule of the invention or used in the process according to the invention involve for example the inoculation of tobacco plants with infectious RNA transcribed in vitro from a cDNA copy of the recombinant viral genome. Another approach utilizes the transfection of whole plants from wounds inoculated with *Agrobacterium tumefaciens* containing cDNA copies of recombinant plus-sense RNA viruses. Different vectors and virus are known to the skilled worker for expression in different target eg. production plants.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular agrobacteria, with a codogenic gene segment or the corresponding plasmid construct comprising the nucleic acid molecule of the invention. This can be carried out in a manner known per se. For example, said nucleic acid construct of the invention, or said expression construct or said plasmid construct, which has been generated in accordance with what has been detailed above, can be transformed into competent agrobacteria by means of electroporation or heat shock. In principle, one must differentiate between the formation of cointegrated vectors on the one hand and the transformation with binary vectors on the other hand. In the case of the first alternative, the constructs, which comprise the codogenic gene segment or the nucleic acid molecule of the invention have no T-DNA sequences, but the formation of the cointegrated vectors or constructs takes place in the agrobacteria by homologous recombination of the construct with T-DNA. The T-DNA is present in the agrobacteria in the form of Ti or Ri plasmids in which exogenous DNA has expediently replaced the oncogenes. If binary vectors are used, they can be transferred to agrobacteria either by bacterial conjugation or by direct transfer. These agrobacteria expediently already comprise the vector bearing the vir genes (currently referred to as helper Ti(Ri) plasmid). As mentioned before the stable integration of the heterologous nucleic acids into the plastidial genome may also be advantegously.

One or more markers may expediently also be used together with the nucleic acid construct, or the vector of the invention and, if plants or plant cells shall be transformed together with the T-DNA, with the aid of which the isolation or selection of transformed organisms, such as agrobacteria or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example XGal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method. In case of plastidal transformation methods other markers genes, like the ones mentioned above like spectomycin resistance gene (aadA) are preferably used.

As a rule, it is desired that the plant nucleic acid constructs are flanked by T-DNA at one or both sides of the codogenic gene segment. This is particularly useful when bacteria of the species *Agrobacterium tumefaciens* or *Agrobacterium rhizogenes* are used for the transformation. A method, which is preferred in accordance with the invention, is the transformation with the aid of *Agrobacterium tumefaciens*. However, biolistic methods may also be used advantageously for introducing the sequences in the process according to the invention, and the introduction by means of PEG is also possible. The transformed agrobacteria can be grown in the manner known per se and are thus available for the expedient transformation of the plants. The plants or plant parts to be transformed are grown or provided in the customary manner. The transformed agrobacteria are subsequently allowed to act on the plants or plant parts until a sufficient transformation rate is reached. Allowing the agrobacteria to act on the plants or plant parts can take different forms. For example, a culture of morphogenic plant cells or tissue may be used. After the T-DNA transfer, the bacteria are, as a rule, eliminated by antibiotics, and the regeneration of plant tissue is induced. This is done in particular using suitable plant hormones in order to initially induce callus formation and then to promote shoot development.

The transfer of foreign genes into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

Further advantageous and suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Hofgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38. For the transformation of plastids physical methods like PEG-treatment (O'Neil et al., 1993 Plant Journal. 3, 729-738, Golds et al., 1993 BioTechnology 11, 95-97) microinjection (Knoblauch et al., 1999, Nat. Biotech. 17, 906-910) or biolistics (Svab et al., 1990, Proc. Natl. Acad. Sci. USA 90, 8526-8530) are preferred. Such transformation methods are especially useful for the direct transformation of plastids and are well known to the skilled worker.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorgansms.

In addition to the sequence mentioned in table I, application no. 1, columns 5 and 7 or its derivatives, it is advantageous additionally to express and/or mutate further genes in the organisms. Especially advantageously, additionally at least one further gene of the amino acid biosynthetic pathway such as for L-lysine, L-threonine and/or L-methionine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the nucleic acids sequences of the invention containing the sequences shown in table I, application no. 1, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous expression of at least one nucleic acid or one of the genes which code for proteins involved in the amino acid metabolism, in particular in amino acid synthesis especially genes selected from the group of gene products consisting of aspartate kinase (lysC), of aspartate-semialdehyde dehydrogenase (asd), of glyceraldehyde-3-phosphate dehydrogenase (gap), of 3-phosphoglycerate kinase (pgk), of pyruvate carboxylase (pyc), of triosephosphate isomerase (tpi), of homoserine 0-acetyltransferase (metA), of cystathionine γ-synthase (metB), of cystathionine gamma-lyase (metC), cystathionine β-lyase, of methionine synthase (metH), of serine hydroxymethyltransferase (glyA), of O-acetylhomoserine sulfhydrylase (metY), of methylenetetrahydrofolate reductase (metF), of phosphoserine aminotransferase (serC), of phosphoserine phosphatase (serB), of serine acetyltransferase (cysE), of cysteine synthase (cysK), of homoserine dehydrogenase (hom) and S-adenosylmethionine synthase (metX) in the cytsol or in the plastids.

A further advantageous nucleic acid sequence which can be expressed in combination with the sequences used in the process and/or the abovementioned biosynthesis genes is the sequence of the ATP/ADP translocator as described in WO 01/20009. This ATP/ADP translocator leads to an increased synthesis of the essential amino acids lysine and/or methionine.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the production according to the invention of the fine chemical is not impaired, or so that their specific enzymatic activity is increased. Less influence means in this connection that the regulation of the enzymic activity is less by at least 10%, advantageously at least 20, 30 or 40%, particularly advantageously by at least 50, 60 or 70%, compared with the starting organism, and thus the activity of the enzyme is increased by these figures mentioned compared with the starting organism. An increase in the enzymatic activity means an enzymatic activity which is increased by at least 10%, advantageously at least 20, 30 or 40%, particularly advantageously by at least 50, 60 or 70%, compared with the starting organism. This leads to an increased productivity of the desired fine chemical or of the desired fine chemicals In a further advantageous embodiment of the process of the invention, the organisms used in the process are those in which simultaneously a the fine chemical degrading protein is attenuated, in particular by reducing the rate of expression of the corresponding gene.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression. These regulatory sequences are intended to enable the specific expression of the genes and the expression of protein. Depending on the host organism for example plant or microorganism, this may mean, for example, that the gene is expressed and/or overexpressed after induction only, or that it is expressed and/or overexpressed constitutively. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators. In another preferred embodiment, the natural or created expression cassette is further modified in such a manner, that a nucleic acid sequence encoding a transitpeptide is functionally introduced between the regulatory and the coding region such, that a functionally preprotein is expressed, which is targeted to the plastids.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be present in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to to the coding sequence of the nucleic acid molecule of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites, promoters for the regulation of expression of the nucleic acid molecule according to the invention in a cell and which can be employed are, in principle, all those which are capable of stimulating the transcription of genes in the organisms in question, such as microorganisms or plants. Suitable promoters, which are functional in these organisms are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants. Furthermore in case of direct transformation of oranelles such as plastids, promoters recognized by the plastid RNA-polymerases such as the plastid encoded *Escherichia coli* like RNA polymerase or the nuclear encoded plastid RNA polymerase my advantageously be used.

The regulatory sequences or factors can, as described above, have a positive effect on, the expression of the genes introduced, thus increasing their expression. Thus, an enhancement of the expression can advantageously take place at the transcriptional level by using strong transcription signals such as strong promoters and/or strong enhancers. In addition, enhancement of expression on the translational level is also possible, for example by introducing translation enhancer sequences, e.g., the Qenhancer e.g. improving the ribosomal binding to the transcript, or by increasing the stability of the mRNA, e.g. by replacing the 3'UTR coding region by a region encoding a 3'UTR known as conferring an high stability of the transcript or by stabilization of the transcript through the elimination of transcript instability, so that the mRNA molecule is translated more often than the wild type. For example in plants AU-rich elements (AREs) and DST (downstream) elements destabilized transcripts. Mutagenesis studies have demonstrated that residues within two of the conserved domains, the ATAGAT and the GTA regions, are necessary for instability function. Therefore removal or mutation of such elements would obviously lead to more stable transcripts, higher transcript rates and higher protein activity. Translation enhancers are also the "overdrive sequence", which comprises the tobacco mosaic virus 5'-untranslated leader sequence and which increases the protein/RNA ratio (Gallie et al., 1987, Nucl. Acids Research 15:8693-8711)

Enhancers are generally defined as cis active elements, which can stimulate gene transcription independent of position and orientation. Different enhancers have been identified in plants, which can either stimulate transcription constitutively or tissue or stimuli specific. Well known examples for constitutive enhancers are the enhancer from the 35S promoter (Odell et al., 1985, Nature 313:810-812) or the ocs enhancer (Fromm et al., 1989, Plant Cell 1: 977:984) Another examples are the GBox motif tetramer which confers high-level constitutive expression in dicot and monocot plants (Ishige et al., 1999, Plant Journal, 18, 443-448) or the petE, a A/T-rich sequence which act as quantitative enhancers of gene expression in transgenic tobacco and potato plants (Sandhu et al., 1998; Plant Mol Biol. 37(5):885-96). Beside that, a large variety of cis-active elements have been described which contribute to specific expression pattern, like organ specific expression or induced expression in response to biotic or abiotic stress. Examples are elements, which provide pathogen or wound-induced expression (Rushton, 2002, Plant Cell, 14, 749-762) or guard cell-specific expression (Plesch, 2001, Plant Journal 28, 455-464).

Advantageous regulatory sequences for the expression of the nucleic acid molecule according to the invention in microorganisms are present for example in promoters such as the cos, tac, rha, trp, tet, trp-tet, lpp, lac, lpp-lac, laCl$^{q-}$, T7, T5, T3, gal, trc, ara, SP6, $\lambda$-P$_R$ or $\lambda$-P$_L$, promoter, which are advantageously used in Gram-negative bacteria. Further advantageous regulatory sequences are present for example in the Gram-positive promoters amy, dnak, xylS and SPO2, in the yeast or fungal promoters ADC1, MF$\alpha$, AC, P-60, UASH, MCB, PHO, CYC1, GAPDH, TEF, rp28, ADH. Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring the expression of advantageous genes can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organism As described above, the transcription of the genes introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene. Terminators, which are useful in microorganism are for example the fimA terminator, txn terminator or trp terminator. Such terminators can be rho-dependent or rho-independent.

Different plant promoters such as, for example, the USP, the LegB4-, the DC3 promoter or the ubiquitin promoter from parsley or other herein mentioned promoter and different terminators may advantageously be used in the nucleic acid construct.

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several genes are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells. The term plant promotor also shall also encompass plastidal promoters.

The plant promoter can also originates from a plant cell, e.g. from the plant, which is transformed with the nucleic acid construct or vector as described herein.
This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination are polyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide or transit-peptide-encoding sequences which are known per se. For example, plastid transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 1, columns 5 and 7 and described herein to achieve an expression in one of said compartments or extracellular.

For expression in plants, the nucleic acid molecule must, as described above, be linked operably to or comprise a suitable promoter which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5):2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention a plant can be advantageous. However, inducible expression of the polypeptide of the invention is advantageous, if a late expression before the harvest is of advantage, as metabolic manipulation may lead to plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinII promoter (EP-A-0 375 091) or others as described herein.

Preferred promoters are in particular those which bring about gene expression in tissues and organs in which the biosynthesis of amino acids takes place, in seed cells, such as endosperm cells and cells of the developing embryo. Suitable promoters are the oilseed rape napin gene promoter (U.S. Pat. No. 5,608,152), the Vicia faba USP promoter (Baeumlein et al., Mol Gen Genet, 1991, 225 (3): 459-67), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley Ipt2 or Ipt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the Glycine max phosphoribosylpyrophosphate amidotransferase promoter (GenBank Accession No. U87999) or the node-specific promoter described in EP-A-0 249 676.

Other promoters, which are particularly suitable, are those which bring about plastid-specific expression. Advantageously such promoters are used. Suitable promoters such as the viral RNA polymerase promoter are described in WO 95/16783 and WO 97/06250, and the *Arabidopsis* cIpP promoter, which is described in WO 99/46394.

Other promoters, which are used for the strong expression of heterologous sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare E-PA 388186, EP-A 335528, WO 97/06268.

As already mentioned herein, further regulatory sequences, which may be expedient, if appropriate, also include sequences, which target the transport and/or the localization of the expression products. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays, Hordeum vulgare*, oats, *Secale cereale, Oryza sativa, Pennisetum glaucum, Sorghum bicolor, Triticale, Agrostis* spp., *Cenchrus ciliaris, Dactylis glomerata, Festuca arundinacea, Lolium* spp., *Medicago* spp. and *Saccharum* spp., legumes and oil crops, for example *Brassica juncea, Brassica napus, Glycine max, Arachis hypogaea, Gossypium hirsutum, Cicer arietinum, Helianthus annuus, Lens culinaris, Linum usitatissimum, Sinapis alba, Trifolium repens* and *Vicia narbonensis*, vegetables and fruits, for example bananas, grapes, *Lycopersicon esculentum*, asparagus, cabbage, watermelons, kiwi fruit, *Solanum tuberosum, Beta vulgaris*, cassava and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced in to a cell, e.g. a microorganism or a plant cell, as described herein for the nucleic acid construct, or below under transformation or transfection or shown in the examples. A transient or stable transformation of the host or target cell is possible, however, a stable transformation is preferred. The vector according to the invention is preferably a vector, which is suitable for expressing the polypeptide according to the invention in a plant. The method can thus also encompass one or more steps for integrating regulatory signals into the vector, in particular signals, which mediate the expression in microorganisms or plants.

Accordingly, the present invention also relates to a vector comprising the nucleic acid molecule characterized herein as part of a nucleic acid construct suitable for plant expression or the nucleic acid molecule according to the invention.

The advantageous vectors of the invention comprise the nucleic acid molecules which encode proteins according to the invention, nucleic acid molecules which are used in the process, or nucleic acid construct suitable for plant expression comprising the nucleic acid molecules used, either alone or in combination with further genes such as the biosynthesis or regulatory genes of the fine chemical metabolism e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional nucleic acids segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, phasmids, phagemids, cosmids, and linear or circular DNA.

The recombinant expression vectors which are advantageously used in the process comprise the nucleic acid molecules according to the invention or the nucleic acid construct according to the invention in a form which is suitable for expressing, in a host cell, the nucleic acid molecules according to the invention or described herein. Accordingly, the recombinant expression vectors comprise one or more regulatory signals selected on the basis of the host cells to be used for the expression, in operable linkage with the nucleic acid sequence to be expressed. Furthermore the vector can comprise plastome sequences of the recipient organism to facilitate integration into the plastidal genome by homologous recombination as mentioned above.

In a recombinant expression vector, "operable linkage" means that the nucleic acid molecule of interest is linked to the regulatory signals in such a way that expression of the nucleic acid molecule is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signals). These regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnolgy, CRC Press, Boca Raton, Fla., Ed.: Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992), Yeast 8:423-488; van den Hondel, (1991), in: More Gene Manipulations in Fungi, J. W. Bennet & L. L. Lasure, Ed., pp. 396-428: Academic Press: San Diego; and van den Hondel, C.A.M.J.J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep.: 583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

In the event it is necessary proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion *E. coli* expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident λ-prophage, which harbors a T7 gn1 gene under the transcriptional control of the lacUV 5 promoter.

Other vectors which are suitable in prokaryotic organisms are known to the skilled worker; these vectors are for example in *E. coli* pLG338, pACYC184, the pBR series, such as pBR322, the pUC series such as pUC18 or pUC19, the M113mp series, pKC30, pRep4, pHS1, pHS2, pPLc236, pMBL24, pLG200, pUR290, pIN-III³-B1, □gt11 or pBdCl, in *Streptomyces* pIJ101, pIJ364, pIJ702 or pIJ361, in *Bacillus* pUB110, pC194 or pBD214, in *Corynebacterium* pSA77 or pAJ667.

In a further embodiment, the expression vector is a yeast expression vector. Examples of vectors for expression in the yeasts *S. cerevisiae* encompass pY-eDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C.A.M.J.J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 2αM, pAG-1, YEp6, YEp13 or pEMBLYe23.

Further vectors, which may be mentioned by way of example, are pALS1, pIL2 or pBB116 in fungi or pLGV23, pGHlac⁺, pBIN19, pAK2004 or pDH51 in plants.

As an alternative, the nucleic acid sequences can be expressed in insect cells using baculovirus expression vectors. Baculovirus vectors, which are available for expressing proteins in cultured insect cells (for example Sf9 cells) encompass the pAc series (Smith et al. (1983) Mol. Cell Biol. 3:2156-2165) and the pVL series (Lucklow and Summers (1989) Virology 170:31-39).

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E. F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 1, columns 5 and 7 or their homologs is functionally linked to a plastidial targeting sequence. A further preferred embodiment of the invention relates to a vector in which a nucleic acid sequence encoding one of the polypeptides shown in table II, application no. 1, columns 5 and 7 or their homologs is functionally linked to a regulatory sequences which permit the expression in plastids.

Accordingly, one embodiment of the invention relates to a host cell, which has been transformed stably or transiently with the vector according to the invention or the nucleic acid molecule according to the invention or the nucleic acid construct according to the invention.

Depending on the host organism, the organisms used in the process according to the invention are cultured or grown in a manner with which the skilled worker is familiar. As a rule, microorganisms are grown in a liquid medium comprising a carbon source, usually in the form of sugars, a nitrogen source, usually in the form of organic nitrogen sources such as yeast extract or salts such as ammonium sulfate, trace elements such as iron salts, manganese salts, magnesium salts, and, if appropriate, vitamins, at temperatures between 0° C. and 100° C., preferably between 10° C. and 60° C., while passing in oxygen. In the event the microorganism is anaerobe, no oxygen is blown through the culture medium. The pH value of the liquid nutrient medium may be kept constant, that is to say regulated during the culturing phase, or not. The organisms may be cultured batchwise, semibatchwise or continuously. Nutrients may be provided at the beginning of the fermentation or fed in semicontinuously or continuously. Advantageously microorganisms such as algae are grown under sunlight in open ponds or in fermentors illuminated with a light intensity between 10 to 2000 µmol/m²×sec, preferred between 100 to 1000 µmol/m²×sec, more preferred between 200 to 800 µmol/m²×sec, most preferred between 300 to 600 µmol/m²×sec. The cells are grown between several hours for example 3 to 48 h and several days 1 to 20 days, preferably 2 to 10 days. Algae as autotrophic organisms grow well in the presence of light as energy source, anorganic hydrogen donors and $CO_2$ as sole carbon source.

The amino acids produced can be isolated from the organism by methods with which the skilled worker is familiar. For example via extraction, salt precipitation and/or ion-exchange chromatography. To this end, the organisms may be disrupted beforehand. The process according to the invention can be conducted batchwise, semibatchwise or continuously. A summary of known culture and isolation techniques can be found in the textbook by Chmiel [Bioprozeβtechnik 1, Einführung in die Bioverfahrenstechnik (Gustav Fischer Verlag, Stuttgart, 1991)], Demain et al. (Industrial Microbiology and Biotechnology, second edition, ASM Press, Washington, D.C., 1999, ISBN 1-55581-128-0] or in the textbook by Storhas (Bioreaktoren und periphere Einrichtungen (Vieweg Verlag, Braunschweig/Wiesbaden, 1994)).

In one embodiment, the present invention relates to a polypeptide encoded by the nucleic acid molecule according to the present invention, preferably conferring an increase in the fine chemical content in an organism or cell after increasing the expression or activity in the cytsol and/or the organelles such as the plastids or mitochondria, preferentially in the plastids.

The present invention also relates to a process for the production of a polypeptide according to the present invention, the polypeptide being expressed in a host cell according to the invention, preferably in a microorganism or a transgenic plant cell.

In one embodiment, the nucleic acid molecule used in the process for the production of the polypeptide is derived from a microorganism such as a eukaryotic or prokaryotic cell, preferably from a eukaryotic cell such as an algae e.g., in one embodiment the polypeptide is produced in a plant cell or plant with a nucleic acid molecule derived from an alga or an other microorganisms but not from plant.

The skilled worker knows that protein and DNA expressed in different organisms differ in many respects and properties, e.g. DNA modulation and imprinting, such as methylation or post-translational modification, as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein. One major difference between proteins expressed in prokaryotic or eukaryotic organisms is the amount and pattern of glycosylation. For example in *E. coli* there are no glycosylated proteins. Proteins expressed in yeasts have a high mannose content in the glycosylated proteins, whereas in plants the glycosylation pattern is complex.

The polypeptide of the present invention is preferably produced by recombinant DNA techniques. For example, a nucleic acid molecule encoding the protein is cloned into an vector (as described above), the vector is introduced into a host cell (as described above) and said polypeptide is expressed in the host cell. Said polypeptide can then be isolated from the cells by an appropriate purification scheme using standard protein purification techniques. Alternative to recombinant expression, the polypeptide or peptide of the present invention can be synthesized chemically using standard peptide synthesis techniques.

Moreover, native polypeptide conferring the increase of the fine chemical in an organism or part thereof can be isolated from cells (e.g., endothelial cells), for example using the antibody of the present invention as described below, in particular, an anti-b2827, anti-YEL046C, YGR255C, YGR289C, YKR043C and/or YLR153C protein antibody or an antibody against polypeptides as shown in table II, application no. 1, columns 5 and 7, which can be produced by standard techniques utilizing the polypeptid of the present invention or fragment thereof, i.e., the polypeptide of this invention. Preferred are monoclonal antibodies.

In one embodiment, the present invention relates to a polypeptide having the amino acid sequence encoded by a nucleic acid molecule of the invention or obtainable by a process of the invention. Said polypeptide confers preferably the aforementioned activity, in particular, the polypeptide confers the increase of the fine chemical in a cell or an organism or a part thereof after increasing the cellular activity, e.g. by increasing the expression or the specific activity of the polypeptide.

In one embodiment, the present invention relates to a polypeptide having the sequence shown in table II, application no. 1, columns 5 and 7 or as coded by the nucleic acid molecule shown in table I, application no. 1, columns 5 and 7 or functional homologues thereof.

In one advantageous embodiment, in the method of the present invention the activity of a polypeptide is increased comprising or consisting of the consensus sequence shown in table IV, application no. 1, columns 7 and in one another embodiment, the present invention relates to a polypeptide comprising or consisting of the consensus sequence shown in table IV, application no. 1, columns 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

In one embodiment not more than 15%, preferably 10%, even more preferred 5%, 4%, 3%, or 2%, most preferred 1% or 0% of the amino acid position indicated by a letter are/is replaced another amino acid.

In one embodiment 20 or less, preferably 15 or 10, preferably 9, 8, 7, or 6, more preferred 5 or 4, even more preferred 3, even more preferred 2, even more preferred 1, most preferred 0 amino acids are inserted into the consensus sequence.

The consensus sequence was derived from a multiple alignment of the sequences as listed in table II. The letters represent the one letter amino acid code and indicate that the amino acids are conserved in all aligned proteins. The letter X stands for amino acids, which are not conserved in all sequences.

In one example, in the cases where only a small selected subset of amino acids are possible at a certain position these amino acids are given in brackets. The number of given X indicates the distances between conserved amino acid residues, e.g. Y-X-(21,23)-F means that conserved tyrosine and phenylalanine residues are separated from each other by minimum 21 and maximum 23 amino acid residues in all investigated sequences.

Conserved domains were identified from multiple alignment of all sequences and are described using a subset of the standard Prosite notation, e.g. the pattern Y-X-(21,23)-[FW] means that a conserved tyrosine is separated by minimum 21 and maximum 23 amino acid residues from either a phenylalanine or tryptophane.

Prosite patterns for conserved domains were generated with the software tool Pratt version 2.1 or manually. Pratt was developed by Inge Jonassen, Dept. of Informatics, University of Bergen, Norway and is described by Jonassen et al. [I. Jonassen, J. F. Collins and D. G. Higgins, Finding flexible patterns in unaligned protein sequences, Protein Science 4 (1995), pp. 1587-1595; I. Jonassen, Efficient discovery of conserved patterns using a pattern graph, Submitted to CABIOS Febr. 1997]. The source code (ANSI C) for the stand-alone program is public available, e.g. at established Bioinformatic centers like EBI (European Bioinformatics Institute).

For generating patterns with the software tool Pratt, following settings were used: PL (max Pattern Length): 100, PN (max Nr of Pattern Symbols): 100, PX (max Nr of consecutive x's): 30, FN (max Nr of flexible spacers): 5, FL (max Flexibility): 30, FP (max Flex.Product): 10, ON (max number patterns): 50. Input sequences for Pratt were distinct regions of the protein sequences exhibiting high similarity as identified from multiple alignments and provided to the program as multiple FASTA files. The minimum number of sequences, which have to match the generated patterns (CM, min Nr of Seqs to Match) was set to at least 80% of the provided sequences. Parameters not mentioned here were used in their default settings.

The Prosite patterns of the conserved domains can be used to search for protein sequences matching this pattern. Various established Bioinformatic centers provide public internet portals for using those patterns in data base searches (e.g. PIR [Protein Information Resource, located at Georgetown University Medical Center] or ExPASy [Expert Protein Analysis System]). Alternatively, stand-alone software is available, like the program Fuzzpro, which is part of the EMBOSS software package. For example, the program Fuzzpro not only allows to search for an exact pattern-protein match but also allows to set various ambiguities in the performed search.

The alignment was performed with the Software AlignX (Sep. 25, 2002) a component of Vector NTI Suite 8.0, InforMax™, Invitrogen™ life science software, U.S. Main Office, 7305 Executive Way, Frederick, Md. 21704, USA with the following settings: For pairwise alignments: gap opening penalty: 10.0; gap extension penalty 0.1. For multiple alignments: Gap opening penalty: 10.0; Gap extension penalty: 0.1; Gap separation penalty range: 8; Residue substitution matrix: blosum62; Hydrophilic residues: G P S N D Q E K R; Transition weighting: 0.5; Consensus calculation options: Residue fraction for consensus: 0.9. Presettings were selected to allow also for the alignment of conserved aminoacids.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 1, columns 5 and 7 by one or more amino acids. In one embodiment, polypeptide distinguishes form the sequence shown in table IIA and/or IIB, application no. 1, columns 5 and 7 by more than 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from the sequence shown in table IIA and/or IIB, application no. 1, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 1, columns 5 and 7.

In one embodiment, the polypeptide of the invention comprises any one of the sequences not known to the public before. In one embodiment, the polypeptide of the invention originates from a non-plant cell, in particular from a microorganism, and was expressed in a plant cell. In one embodiment, the present invention relates to a polypeptide encoded by the nucleic acid molecule of the invention or used in the process of the invention for which an activity has not been described yet.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 1, columns 5 and 7 by one or more amino acids. In another embodiment, said polypeptide of the invention does not consist of the sequence shown in table IIA and/or IIB, application no. 1, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IIB, application no. 1, columns 5 and 7.

In one embodiment, the present invention relates to a polypeptide having the activity of the protein as shown in table IIA and/or IIB, application no. 1, column 3, which distinguishes over the sequence depicted in table IIA and/or IIB, application no. 1, columns 5 and 7 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include post-translational modifications of the polypeptide, for example, glycosylations, acetylations, phosphorylations and the like. Included within the definition are, for example, polypeptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques or chemical precursors or other chemicals when chemically synthesized. The language "substantially free of cellular material" includes preparations of the polypeptide of the invention in which the protein is separated from cellular components of the cells in which it is naturally or recombinantly produced. In one embodiment, the language "substantially free of cellular material" includes preparations having less than about 30% (by dry weight) of "contaminating protein", more preferably less than about 20% of "contaminating protein", still more preferably less than about 10% of "contaminating protein", and most preferably less than about 5% "contaminating protein". The term "Contaminating protein". relates to polypeptides, which are not polypeptides of the present invention. When the polypeptide of the present invention or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations in which the polypeptide of the present invention is separated from chemical precursors or other chemicals, which are involved in the synthesis of the protein. The language "substantially free of chemical precursors or other chemicals" includes preparations having less than about 30% (by dry weight) of chemical precursors, other chemicals or other proteins, which are not identical to the proteins as shown in table IIA and/or IIB, column 3, 5 or 7. Other chemical precursors, other chemicals or other proteins, which are not identical to the proteins as shown in table II, column 3, 5 or 7 are all collectively named as impurities. The term "chemical precursors" shall mean in the sense of the specification chemical substances, which are intermediates of the biochemical pathway within the organism or within the cell(s) of the organism for example glucose-6-phoshat, citrate, fumarate, homoserine etc. The term "other chemicals" shall mean in the sense of the specification chemical substances, which are end products of the biochemical pathway within the organism or within the cell(s) of the organism for example amino acids such as lysine, alanine etc; fatty acids such as linolenic acid, eicosapantaenoic acid etc, sugars such as glucose, mannose, ribose, desoxy ribose etc, vitamins such as vitamin C, vitamin B2 etc. and all other chemical substances of the cell. The term "other proteins" shall mean in the sense of the specification all other proteins, which are not identical to the proteins mentioned in table II, columns 2, 5 and 7. The fine chemical preparations advantageously shall have less than about 25% impurities, preferably less than about 20% impurities, still more preferably less than about 10% impurities, and most preferably less than about 5% impurities. In preferred embodiments, isolated proteins or biologically active portions thereof lack contaminating proteins from the same organism from which the polypeptide of the present invention is derived. Typically, such proteins are produced by recombinant techniques.

A polypeptide of the invention can participate in the process of the present invention. The polypeptide or a portion thereof comprises preferably an amino acid sequence, which is sufficiently homologous to an amino acid sequence shown in table IIA and/or IIB, application no. 1, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 1, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IIB, application no. 1, columns 5 and 7 or which is homologous thereto, as defined above.

Accordingly the polypeptide of the present invention can vary from the sequences shown in table IIA and/or IIB, application no. 1, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 1, columns 5 and 7.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443453 (1970)] and Smith and Waterman [Adv. Appl. Math. 2; 482489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: −2.003.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 1, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a polypeptide of the present invention or used in the process of the present invention. Moreover, other biologically active portions, in which other regions of the polypeptide are deleted, can be prepared by recombinant techniques and evaluated for one or more of the activities described herein.

Manipulation of the nucleic acid molecule of the invention may result in the production of a protein having differences from the wild-type protein as shown in table II, application no. 1, column 3. Differences shall mean at least one amino acid different from the sequences as shown in table II, application no. 1, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 1, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 1, column 3. The nucleic acid molecules and polypeptide molecules of the invention are expressed such that the yield, production, and/or efficiency of production of a desired compound is improved.

This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention. Preferably, the compound is a composition of amino acids or a recovered amino acid, in particular, the fine chemical, free or in protein-bound form.

The invention also provides chimeric or fusion proteins.

As used herein, an "chimeric protein" or "fusion protein" comprises an polypeptide operatively linked to a polypeptide which does not confer above-mentioned activity, in particular, which does not confer an increase of content of the fine chemical in a cell or an organism or a part thereof, if its activity is increased.

In one embodiment, a protein (=polypeptide) as shown in table II, application no. 1, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 1, column 3, e.g., a protein which does not confer the activity described herein and which is derived from the same or a different organism.

Within the fusion protein, the term "operatively linked" is intended to indicate that the polypeptide of the invention or a polypeptide used in the process of the invention and the "other polypeptide" or a part thereof are fused to each other so that both sequences fulfil the proposed function addicted to the sequence used. The "other polypeptide" can be fused to the N-terminus or C-terminus preferable to the C-terminus of the polypeptide of the invention or used in the process of the invention. For example, in one embodiment the fusion protein is a GST-LMRP fusion protein in which the sequences of the polypeptide of the invention or the polypeptide used in the process of the invention are fused to the C-terminus of the GST sequences. Such fusion proteins can facilitate the purification of recombinant polypeptides of the invention or a polypeptide useful in the process of the invention.

In another preferred embodiment, the fusion protein is a polypeptide of the invention or a polypeptide used in the process of the invention containing a heterologous signal sequence at its N-terminus. In certain host cells (e.g., mammalian host cells), expression and/or secretion of a polypeptide of the invention or a poylpeptide used in the process of the invention can be increased through use of a heterologous signal sequence. As already mentioned above, targeting sequences, are required for targeting the gene product into specific cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. The fusion gene can be synthesized by conventional techniques including automated DNA synthesizers. Alternatively, PCR amplification of gene fragments can be carried out using anchor primers, which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). The nucleic acid molecule of the invention can be cloned into such an expression vector such that the fusion moiety is linked in-frame to the encoded protein.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modeling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites the polypeptide of the invention or polypeptides used in the process of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the, natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Furthermore, a three-dimensional and/or crystallographic structure of the protein of the invention and the identification of interactive sites the polypeptide of the invention and its substrates or binding factors can be used for design of mutants with modulated binding or turn over activities. For example, the active center of the polypeptide of the present invention can be modelled and amino acid residues participating in the catalytic reaction can be modulated to increase or decrease the binding of the substrate to activate or improve the polypeptide. The identification of the active center and the amino acids involved in the catalytic reaction facilitates the screening for mutants having an increased activity.

The sequences shown herein have also been described under its protein name as described in table I or II, column 3.

In an especially preferred embodiment, the polypeptide according to the invention furthermore also does not have the sequences of those proteins which are encoded by the sequences shown in table II, application no. 1, columns 5 and 7.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, prepared in plants described herein. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfr6, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens are equivalent to other ligand/anti-ligand binding.

A further embodiment of the invention also relates to a method for the generation of a transgenic host or host cell, e.g. a eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, prokaryotic or eukaryotic cell, preferably a transgenic microorganism such as a transgenic algae, a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants which are grown for the production of the fine chemical.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M. W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., 2nd Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, Agrobacterium protocols, Ed.: Gartland Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method-, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S. D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). Agrobacteria transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S. D. Kung and R. Wu, Academic Press, 1993, pp. 15-38. Alternatively the construct to be expressed can be cloned into vectors suitable for plastid transformation, as for example described in WO2004029256, WO2004004445 or Dufourmantel et al., 2004, Plant Mol. Biol. 55, 479-489.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as β-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. In case of transformation with Agrobacteria, the transformants usually receive only a part of the vector, the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase resource or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. CreI is a recombinase, which removes the sequences located between the loxP sequences. If the marker gene is integrated between the loxP sequences, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria. Also methods for the production of marker-free plastid transformants using a transiently cointegrated selection gene have been described for example by Koop et al., Nature Biotechnology, (2004) 22, 2, 225-229.

Agrobacteria transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassava, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic (Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289). Alternative methods are based on the repeated removal of the influorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the "floral dip" method the developing floral tissue is incubated briefly with a surfactant-treated agrobacterial suspension (Clough, S J und Bent, A F (1998). The Plant J. 16, 735-743). A certain proportion of transgenic seeds are harvested in both cases, and these seeds can be distinguished from nontransgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process, which has been schematically displayed in Klaus et al., 2004 (Nature Biotechnology 22(2), 225-229). Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview can be taken from Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient cointegrated maker gene (Klaus et al., 2004, Nature Biotechnology 22(2), 225-229).

The genetically modified plant cells can be regenerated via all methods with which the skilled worker is familiar. Suitable methods can be found in the abovementioned publications by S. D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 1, column 3. Due to the above mentioned activity the fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 1, column 3 or a protein as shown in table II, application no. 1, column 3-like activity is increased in the cell or organism or part thereof especially in organelles such as plastids or mitochondria. Examples are described above in context with the process of the invention.

"Transgenic", for example regarding a nucleic acid molecule, an nucleic acid construct or a vector comprising said nucleic acid molecule or an organism transformed with said nucleic acid molecule, nucleic acid construct or vector, refers to all those subjects originating by recombinant methods in which either a) the nucleic acid sequence, or
b) a genetic control sequence linked operably to the nucleic acid sequence, for example a promoter, or
c) (a) and (b)

are not located in their natural genetic environment or have been modified by recombinant methods, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1000 bp, very especially preferably at least 5000 bp, in length.

A naturally occurring expression cassette—for example the naturally occurring combination of the promoter of the gene encoding a protein as shown in table II, application no. 1, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase of the fine chemical.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids used in the process according to the invention occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

In an especially preferred embodiment, the organism, the host cell, plant cell, plant, microorganism or plant tissue according to the invention is transgenic.

Accordingly, the invention therefore relates to transgenic organisms transformed with at least one nucleic acid molecule, nucleic acid construct or vector according to the invention, and to cells, cell cultures, tissues, parts—such as, for example, in the case of plant organisms, plant tissue, for example leaves, roots and the like—or propagation material derived from such organisms, or intact plants. The terms "recombinant (host)", and "transgenic (host)" are used interchangeably in this context. Naturally, these terms refer not only to the host organism or target cell in question, but also to the progeny, or potential progeny, of these organisms or cells. Since certain modifications may occur in subsequent generations owing to mutation or environmental effects, such progeny is not necessarily identical with the parental cell, but still comes within the scope of the term as used herein.

Suitable organisms for the process according to the invention or as hosts are all these eukaryotic organisms, which are capable of synthesizing the fine chemcial. The organisms used as hosts are microorganisms, such as algae or plants, such as dictotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

Preferred plant cells, plant organs, plant tissues or parts of plants originate from the under source organism mentioned plant families, preferably from the abovementioned plant genus, more preferred from abovementioned plants species.

Transgenic plants comprising the amino acids synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The amino acids produced in the process according to the invention may, however, also be isolated from the plant in the form of their free amino acids or bound in proteins. Amino acids produced by this process can be harvested by harvesting the organisms either from the culture in which they grow or from the field. This can be done via expressing, grinding and/or extraction, salt precipitation and/or ion-exchange chromatography of the plant parts, preferably the plant seeds, plant fruits, plant tubers and the like.

In a further embodiment, the present invention relates to a process for the generation of a microorganism, comprising the introduction, into the microorganism or parts thereof, of the nucleic acid construct of the invention, or the vector of the invention or the nucleic acid molecule of the invention.

In another embodiment, the present invention relates also to a transgenic microorganism comprising the nucleic acid molecule of the invention, the nucleic acid construct of the invention or the vector as of the invention. Appropriate microorganisms have been described herein before under source organism, preferred are in particular aforementioned strains suitable for the production of fine chemicals.

Accordingly, the present invention relates also to a process according to the present invention whereby the produced amino acid composition or the produced the fine chemical is isolated.

In this manner, more than 50% by weight, advantageously more than 60% by weight, preferably more than 70% by weight, especially preferably more than 80% by weight, very especially preferably more than 90% by weight, of the amino acids produced in the process can be isolated. The resulting amino acids can, if appropriate, subsequently be further purified, if desired mixed with other active ingredients such as vitamins, amino acids, carbohydrates, antibiotics and the like, and, if appropriate, formulated.

In one embodiment, the amino acid is the fine chemical.

The amino acids obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of a pharmaceuticals, food stuff, animal feeds, nutrients or cosmetics comprising the steps of the process according to the invention, including the isolation of the amino acid composition produced or the fine chemical produced if desired and formulating the product with a pharmaceutical acceptable carrier or formulating the product in a form acceptable for an application in agriculture. A further embodiment according to the invention is the use of the amino acids produced in the process or of the transgenic organisms in animal feeds, foodstuffs, medicines, food supplements, cosmetics or pharmaceuticals.

In principle all microorganisms can be used as host organism especially the ones mentioned under source organism above. It is advantageous to use in the process of the invention transgenic microorganisms such as algae selected from the group of the families Bacillariophyceae, Charophyceae, Chlorophyceae, Chrysophyceae, Craspedophyceae, Euglenophyceae, Prymnesiophyceae, Phaeophyceae, Dinophyceae, Rhodophyceae, Xanthophyceae, Prasinophyceae and its described species and strains. Examples for such algae are the following species *Isochrysis galbana, Chaetoceros gracilis, Chaetoceros calcitrans, Tetraselmis suecica, Thalassiosira pseudonana, Pavlova lutheri, Isochrysis* sp., *Skeletonema costatum, Chroomonas salina, Dunaliella tertiolecta, Chaetoceros simplex, Chaetoceros muelleri, Nannochloropsis* sp., *Cyclotella* sp., *Phaeodactylum tricornutum, Tetraselmis chui, Pavlova salina, Dicruteria* sp., *Tetraselmis levis, Dunaliella perva, Thalassiosira weissfloggii, Chlamydomonas* sp., *Chlorella vulgaris, Neochloris oleoabundans* or *Chlorella* sp, which are only smahl overview.

The process of the invention is, when the host organisms are microorganisms, advantageously carried out at a temperature between 0° C. and 95° C., preferably between 10° C. and 85° C., particularly preferably between 15° C. and 75° C., very particularly preferably between 15° C. and 45° C. The pH is advantageously kept at between pH 4 and 12, preferably between pH 6 and 9, particularly preferably between pH 7 and 8, during this. The process of the invention can be operated batchwise, semibatchwise or continuously. A summary of known cultivation methods is to be found in the textbook by Chmiel (Bioprozelβtechnik 1. Einführung in die Bioverfahrenstechnik (Gustav Fischer Verlag, Stuttgart, 1991)) or in the textbook by Storhas (Bioreaktoren und periphere Einrichtungen (Vieweg Verlag, Braunschweig/Wiesbaden, 1994)). The culture medium to be used must meet the requirements of the respective strains in a suitable manner. Descriptions of culture media for various microorganisms are present in the handbook "Manual of Methods for General Bacteriology" of the American Society for Bacteriology (Washington D.C., USA, 1981) and for algae in McLellan et al. [(1991): Maintenance of algae and protozoa. -A. Doyle and B. Kirsop (eds.) Maintenance of Microorganisms London: 183-208]; Provasoli et al. [(1960): Artificial media for freshwater algae: problems and suggestions. -R. T. Hartman (eds.) The Ecology of Algae. Pymatunig Laboratory of Field Biology Special publication 2, University of Pittsburgh: 84-96] or Starr, R. C. [(1971): Algal cultures-sources and methods of cultivation— A. San Pietro (eds.) Photosynthesis Part A, Methods in Enzymology 23, N.Y.: 29-53]. These media, which can be employed according to the invention include, as described above, usually one or more carbon sources, nitrogen sources, inorganic salts, vitamins and/or trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars can also be added to the media via complex compounds such as molasses, or other byproducts of sugar refining. It may also be advantageous to add mixtures of various carbon sources. Other possible carbon sources are oils and fats such as, for example, soybean oil, sunflower oil, peanut oil and/or coconut fat, fatty acids such as, for example, palmitic acid, stearic acid and/or linoleic acid, alcohols and/or polyalcohols such as, for example, glycerol, methanol and/or ethanol and/or organic acids such as, for example, acetic acid and/or lactic acid. Nitrogen sources are usually organic or inorganic nitrogen compounds or materials, which contain these compounds. Examples of nitrogen sources include ammonia in liquid or gaseous form or ammonium salts such as ammonium sulfate, ammonium chloride, ammonium phosphate, ammonium carbonate or ammonium nitrate, nitrates, urea, amino acids or complex nitrogen sources such as corn steep liquor, soybean meal, soybean protein, yeast extract, meat extract and others. The nitrogen sources may be used singly or as a mixture. Inorganic salt compounds, which may be present in the media include the chloride, phosphorus or sulfate salts of calcium, magnesium, sodium, cobalt, molybdenum, potassium, manganese, zinc, copper and iron. For the cultivation of algae the so called soilwater media are preferred. Such media are composed of soil extract, trace element solutions, filtered seawater, a nitrogen source and a buffer substance. Such culture media are well known by the skilled person and are available for example from culture collections such as the culture collection of algae (SAG) at the University of Göttingen, the Culture collection of algae in Coimbra, Portugal (ACOI) or the culture collection of algae (UTEX) in Texas, USA.

For preparing sulfur-containing fine chemicals, in particular the fine chemical, it is possible to use as sulfur source inorganic sulfur-containing compounds such as, for example, sulfates, sulfites, dithionites, tetrathionates, thiosulfates, sulfides or else organic sulfur compounds such as mercaptans and thiols.

It is possible to use as phosphorus source phosphoric acid, potassium dihydrogenphosphate or dipotassium hydrogenphosphate or the corresponding sodium-containing salts.

Chelating agents can be added to the medium in order to keep the metal ions in solution. Particularly suitable chelating agents include dihydroxyphenols such as catechol or protocatechuate, or organic acids such as citric acid. The fermentation media employed according to the invention for cultivating microorganisms normally also contain other growth factors such as vitamins or growth promoters, which include, for example, biotin, riboflavin, thiamine, folic acid, nicotinic acid, pantothenate and pyridoxine. All media components are sterilized either by heat (1.5 bar and 121° C. for 20 min) or by sterilizing filtration. The components can be sterilized either together or, if necessary, separately. All media components can be present at the start of the cultivation or optionally be added continuously or batchwise. The temperature of the culture is normally between 0° C. and 55° C., preferably at 10° C. to 30° C., and can be kept constant or changed during the experiment. The pH of the medium should be in the range from 3.5 to 8.5, preferably in the range between 5 to 7. The pH for the cultivation can be controlled during the cultivation by adding basic compounds such as sodium hydroxide, potassium hydroxide, ammonia or aqueous ammonia or acidic compounds such as phosphoric acid or sulfuric acid. Foaming can be controlled by employing antifoams such as, for example, fatty acid polyglycol esters. The stability of plasmids can be maintained by adding to the medium suitable substances having a selective effect, for example antibiotics. Aerobic conditions are maintained by introducing oxygen or oxygen-containing gas mixtures such as, for example, ambient air into the culture. The temperature of the culture is normally from 20° C. to 45° C. and preferably from 25° C. to 40° C. The culture is continued until formation of the desired product is at a maximum. This aim is normally achieved within 10 hours to 160 hours.

The fermentation broths obtained in this way, containing in particular L-methionine, L-threonine and/or L-lysine preferably L-methionine, normally have a dry matter content of from 7.5 to 25% by weight. The fermentation broth can be processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

However, it is also possible to purify the amino acid produced further. For this purpose, the product-containing composition is subjected to a chromatography on a suitable resin, in which case the desired product or the impurities are retained wholly or partly on the chromatography resin. These chromatography steps can be repeated if necessary, using the same or different chromatography resins. The skilled worker is familiar with the choice of suitable chromatography resins and their most effective use. The purified product can be concentrated by filtration or ultrafiltration and stored at a temperature at which the stability of the product is a maximum.

The identity and purity of the isolated compound(s) can be determined by prior art techniques. These include high performance liquid chromatography (HPLC), spectroscopic methods, mass spectrometry (MS), staining methods, thin-layer chromatography, NIRS, enzyme assay or microbiological assays. These analytical methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

The invention furthermore relates to the use of the transgenic organisms according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule, the organism, e.g. the microorganism, the plant, plant cell or plant tissue, the vector, or the polypeptide of the present invention for making fatty acids, carotenoids, isoprenoids, vitamins, lipids, wax esters, (poly)saccharides and/or polyhydroxyalkanoates, and/or its metabolism products, in particular, steroid hormones, cholesterol, prostaglandin, triacylglycerols, bile acids and/or ketone bodies producing cells, tissues and/or plants. There are a number of mechanisms by which the yield, production, and/or efficiency of production of fatty acids, carotenoids, isoprenoids, vitamins, wax esters, lipids, (poly)saccharides and/or polyhydroxyalkanoates, and/or its metabolism products, in particular, steroid hormones, cholesterol, triacylglycerols, prostaglandin, bile acids and/or ketone bodies or further of above defined fine chemicals incorporating such an altered protein can be affected. In the case of plants, by e.g. increasing the expression of acetyl-CoA which is the basis for many products, e.g., fatty acids, carotenoids, isoprenoids, vitamines, lipids, (poly)saccharides, wax esters, and/or polyhydroxyalkanoates, and/or its metabolism products, in particular, prostaglandin, steroid hormones, cholesterol, triacylglycerols, bile acids and/or ketone bodies in a cell, it may be possible to increase the amount of the produced said compounds thus permitting greater ease of harvesting and purification or in case of plants more efficient partitioning. Further, one or more of said metabolism products, increased amounts of the cofactors, precursor molecules, and intermediate compounds for the appropriate biosynthetic pathways maybe required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of acetyl CoA and its metabolism products as mentioned above, due to the removal of any nutrient supply limitations on the biosynthetic process. In particular, it may be possible to increase the yield, production, and/or efficiency of production of said compounds, e.g. fatty acids, carotenoids, isoprenoids, vitamins, was esters, lipids, (poly)saccharides, and/or polyhydroxyalkanoates, and/or its metabolism products, in particular, steroid hormones, cholesterol, prostaglandin, triacylglycerols, bile acids and/or ketone bodies molecules etc. in plants.

Further in another embodiment, the present invention relates to the use of the nucleic acid molecule of the invention or used in the method of the invention alone or in combination with other genes of the respective fine chemical synthesis for example of the amino acid biosynthesis, the polypeptide of the invention or used in the method of the invention, the nucleic acid construct of the invention, the vector of the invention, the plant or plant tissue or the host cell of the invention, for the production of plant resistant to a herbicide inhibiting the production of leucine, isoleucine and/or valine.

Furthermore preferred is a method for the recombinant production of pharmaceuticals or fine chemicals in host organisms, wherein a host organism is transformed with one of the above-described nucleic acid constructs comprising one or more structural genes which encode the desired fine chemical or catalyze the biosynthesis of the desired fine chemical, the transformed host organism is cultured, and the desired fine chemical is isolated from the culture medium. This method can be applied widely to fine chemicals such as enzymes, vitamins, amino acids, sugars, fatty acids, and natural and synthetic flavorings, aroma substances and colorants or compositions comprising these. Especially preferred is the additional production of further amino acids, tocopherols and tocotrienols and carotenoids or compositions comprising said compounds. The transformed host organisms are cultured and the products are recovered from the host organisms or the culture medium by methods known to the skilled worker or the organism itself servers as food or feed supplement. The production of pharmaceuticals such as, for example, antibodies or vaccines, is described by Hood E E, Jilka J M. Curr Opin Biotechnol. 1999 August; 10(4):382-6; Ma J K, Vine N D. Curr Top Microbiol Immunol. 1999; 236:275-92.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 1, columns 5 and 7, preferably in table IB, application no. 1, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60°-68° C. with 0.1% SDS. Further examples can be found in the references listed above for the stringend hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In another embodiment, the present invention relates to a method for the identification of a gene product conferring an increase in the fine chemical production in a cell, comprising the following steps:
(a) identifying nucleic acid molecules of an organism; which can contain a candidate gene encoding a gene product conferring an increase in the fine chemical after expression, which are at least 20%, preferably 25%, more preferably 30%, even more preferred are 35%. 40% or 50%, even more preferred are 60%, 70% or 80%, most preferred are 90% or 95% or more homology to the nucleic acid molecule of the present invention, for example via homology search in a data bank;
(b) introducing the candidate nucleic acid molecules in host cells, preferably in a plant cells or microorganisms, appropriate for producing the fine chemical;
(c) expressing the identified nucleic acid molecules in the host cells;
(d) assaying the fine chemical level in the host cells; and
(e) identifying the nucleic acid molecule and its gene product which expression confers an increase in the fine chemical level in the host cell after expression compared to the wild type.

The nucleic acid molecules identified can then be used for the production of the fine chemical in the same way as the nucleic acid molecule of the present invention. Accordingly, in one embodiment, the present invention relates to a process for the production of the fine chemical, comprising (a) identifying a nucleic acid molecule according to aforementioned steps (a) to (f) or (a) to (e) and recovering the free or bound fine chemical from an organism having an increased cellular activity of a polypeptide encoded by the isolated nucleic acid molecule compared to a wild type.

Furthermore, in one embodiment, the present invention relates to a method for the identification of a compound stimulating production of the fine chemical to said plant comprising:
a) contacting cells which express the polypeptide of the present invention or its mRNA with a candidate compound under cell cultivation conditions;
b) assaying an increase in expression of said polypeptide or said mRNA;
c) comparing the expression level to a standard response made in the absence of said candidate compound; whereby, an increased expression over the standard indicates that the compound is stimulating production of the fine chemical.

Furthermore, in one embodiment, the present invention relates to process for the identification of a compound conferring increased the fine chemical production in a plant or microorganism, comprising the steps:
(a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and (b) identifying if the compound is an effective agonist by detecting the presence or absence or increase of a signal produced by said readout system.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 1, column 3, e.g. comparing near identical organisms with low and high activity of the proteins as shown in table II, application no. 1, column 3.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing or activating the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the content of the fine chemical in an organism or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the above-described method or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, N.Y., USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifying an agonist of the invention said compound being an agonist of the polypeptide of the present invention or used in the process of the present invention.

Accordingly, in one embodiment, the present invention further relates to a compound identified by the method for identifying a compound of the present invention.

Said compound is, for example, a homologous of the polypeptide of the present invention. Homologues of the polypeptide of the present invention can be generated by mutagenesis, e.g., discrete point mutation or truncation of the polypeptide of the present invention. As used herein, the term "homologue" refers to a variant form of the protein, which acts as an agonist of the activity of the polypeptide of the present invention. An agonist of said protein can retain substantially the same, or a subset, of the biological activities of the polypeptide of the present invention. In particular, said agonist confers the increase of the expression level of the polypeptide of the present invention and/or the expression of said agonist in an organisms or part thereof confers the increase of free and/or bound the fine chemical in the organism or part thereof.

In one embodiment, the invention relates to an antibody specifically recognizing the compound or agonist of the present invention.

In a further embodiment, the present invention relates to a method for the production of a agricultural composition providing the nucleic acid molecule, the vector or the polypeptide of the invention or comprising the steps of the method according to the invention for the identification of said compound, agonist; and formulating the nucleic acid molecule, the vector or the polypeptide of the invention or the agonist, or compound identified according to the methods or processes of the present invention or with use of the subject matters of the present invention in a form applicable as plant agricultural composition.

In another embodiment, the present invention relates to a method for the production of a "the fine chemical"-production supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbizides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for the fine chemical production as mentioned and related organisms; mapping of genomes; identification and localization of sequences of interest; evolutionary studies; determination of regions required for function; modulation of an activity.

The nucleic acid molecule of the invention, the vector of the invention or the nucleic acid construct of the invention may also be useful for the production of organisms resistant to inhibitors of the amino acid production biosynthesis pathways. In particular, the overexpression of the polypeptide of the present invention in the cytsol or more preferred in the plastids may protect plants against herbicides, which block the amino acid, in particular the fine chemical, synthesis in said plant. Examples of herbicides blocking the amino acid synthesis in plants are for example sulfonylurea and imidazolinone herbicides, which catalyze the first step in branched-chain amino acid biosynthesis.

Accordingly, the nucleic acid molecules of the present invention have a variety of uses. First, they may be used to identify an organism or a close relative thereof. Also, they may be used to identify the presence thereof or a relative thereof in a mixed population of microorganisms or plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention may be sufficiently homologous to the sequences of related species such that these nucleic acid molecules may serve as markers for the construction of a genomic map in related organism.

Accordingly, the present invention relates to a method for breeding plants for the production of the fine chemical, comprising
(a) providing a first plant variety produced according to the process of the invention preferably (over) expressing the nucleic acid molecule of the invention;
(b) crossing the first plant variety with a second plant variety; and
(c) selecting the offspring plants which overproduce the fine chemical by means of analysis the distribution of a molecular marker in the offspring representing the first plant variety and its capability to (over) produce the fine chemical.

Details about the use of molecular markers in breeding can be found in Kumar et al., 1999 (Biotech Adv., 17:143-182) and Peleman and van der Voort 2003 (Trends Plant Sci. 2003 July; 8(7):330-334)

The molecular marker can e.g. relate to the nucleic acid molecule of the invention and/or its expression level. Accordingly, the molecular marker can be a probe or a PCR primer set useful for identification of the genomic existence or genomic localisation of the nucleic acid molecule of the invention, e.g. in a Southern blot analysis or a PCR or its expression level, i.g. in a Northern Blot analysis or a quantitative PCR. Accordingly, in one embodiment, the present invention relates to the use of the nucleic acid molecule of the present invention or encoding the polypeptide of the present invention as molecular marker for breeding.

The nucleic acid molecules of the invention are also useful for evolutionary and protein structural studies. By comparing the sequences of the invention or used in the process of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention can be used for the identification of other nucleic acids conferring an increase of the fine chemical after expression.

Further, the nucleic acid molecule of the invention or a fragment of a gene conferring the expression of the polypeptide of the invention, preferably comprising the nucleic acid molecule of the invention, can be used for marker assisted breeding or association mapping of the fine chemical derived traits.

Accordingly, the nucleic acid of the invention, the polypeptide of the invention, the nucleic acid construct of the invention, the organisms, the host cell, the microorgansms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other amino acids, in particular Threonine, Alanine, Glutamin, Glutamic acid, Valine, Aspargine, Phenylalanine, Leucine, Proline, Tryptophan Tyrosine, Valine, Isoleucine and Arginine.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the fine chemical in a organism or part thereof, e.g. in a cell.

Further, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention or the nucleic acid molecule identified with the method of the present invention, can be used for the preparation of an agricultural composition.

Furthermore, the nucleic acid of the invention, the polypeptide of the invention, the nucleic acid construct of the invention, the organisms, the host cell, the microorganisms, the plant, plant tissue, plant cell, or the part thereof of the invention, the vector of the invention or the agonist identified with the method of the invention, the antibody of the present invention or the nucleic acid molecule identified with the method of the present invention, can be used for the identification and production of compounds capable of conferring a modulation of the fine chemical levels in an organism or parts thereof, preferably to identify and produce compounds conferring an increase of the fine chemical levels in an organism or parts thereof, if said identified compound is applied to the organism or part thereof, i.e. as part of its food, or in the growing or culture media.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet, for example under hftp://www.ncbi.nim.nih.gov/PubMed/medline.html. Further databases and addresses, such as hftp://www.ncbi.nlm.nih.gov/, hftp://www.infobiogen.fr/, hftp://www.fmi.ch/biology/research-tools.html, hftp://www.tigr.org/, are known to the person skilled in the art and can also be obtained using, e.g., hftp://www.lycos.com. An overview of patent information in biotechnology and a survey of relevant sources of patent information useful for retrospective searching and for current awareness is given in Berks, TIBTECH 12 (1994), 352-364.

Table 1 gives an overview about the sequences disclosed in the present invention.
1) Increase of the metabolites:
    Max: maximal x-fold (normalised to wild type)
    Min: minimal x-fold (normalised to wild type)
2) Decrease of the metabolites:
    Max: maximal x-fold (normalised to wild type) (minimal decrease)
    Min: minimal x-fold (normalised to wild type) (maximal decrease)

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLES

Example 1

Cloning of the Inventive Sequences as Shown in Table I, Column 5 and 7 in *Escherichia coli*

The inventive sequences as shown in table I, column 5 and 7 were cloned into the plasmids pBR322 (Sutcliffe, J. G. (1979) Proc. Natl Acad. Sci. USA, 75: 3737-3741); pACYC177 (Change & Cohen (1978) J. Bacteriol. 134: 1141-1156); plasmids of the pBS series (pBSSK+, pBSSK− and others; Stratagene, LaJolla, USA) or cosmids such as SuperCos1 (Stratagene, LaJolla, USA) or Lorist6 (Gibson, T. J. Rosenthal, A., and Waterson, R. H. (1987) Gene 53: 283-286) for expression in *E. coli* using known, well-established procedures (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

Example 2

DNA Sequencing and Computerized Functional Analysis

The DNA was sequenced by standard procedures, in particular the chain determination method, using ABI377 sequencers (see, for example, Fleischman, R. D. et al. (1995) "Whole-genome Random Sequencing and Assembly of Haemophilus Influenzae Rd., Science 269; 496-512)".

Example 3

In-Vivo and In-Vitro Mutagenesis

An in vivo mutagenesis of organisms such as *Saccharomyces, Mortierella, Escherichia* and others mentioned above, which are beneficial for the production of fatty acids can be carried out by passing a plasmid DNA (or another vector DNA) containing the desired nucleic acid sequence or nucleic acid sequences through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34. In-vitro mutation methods such as increasing the spontaneous mutation rates by chemical or physical treatment are well known to the skilled person. Mutagens like 5-bromo-uracil, N-methyl-N-nitro-N-nitrosoguanidine (=NTG), ethyl methanesulfonate (=EMS), hydroxylamine and/or nitrous acid are widly used as chemical agents for random in-vitro mutagensis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired fine chemical.

Example 4

DNA transfer between *Escherichia coli*, *Saccharomyces cerevisiae* and *Mortierella alpina*

Shuttle vectors such as pYE22m, pPAC-ResQ, pClasper, pAUR224, pAMH10, pAML10, pAMT10, pAMU10, pGMH10, pGML10, pGMT10, pGMU10, pPGAL1, pPADH1, pTADH1, pTAex3, pNGA142, pHT3101 and derivatives thereof which alow the transfer of nucleic acid sequences between *Escherichia coli*, *Saccharomyces cerevisiae* and/or *Mortierella alpina* are available to the skilled worker. An easy method to isolate such shuttle vectors is disclosed by Soni R. and Murray J. A. H. [Nucleic Acid Research, vol. 20 no. 21, 1992: 5852]: If necessary such shuttle vectors can be constructed easily using standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons) and/or the aforementioned vectors, which have a replication origin for, and suitable marker from, *Escherichia coli, Saccharomyces cerevisiae* or *Mortierella alpina* added. Such replication origins are preferably taken from endogenous plasmids, which have been isolated from species used in the inventive process. Genes, which are used in particular as transformation markers for these species are genes for kanamycin resistance (such as those which originate from the Tn5 or Tn-903 transposon) or for chloramphenicol resistance (Winnacker, E. L. (1987) "From Genes to Clones—Introduction to Gene Technology, VCH, Weinheim) or for other antibiotic resistance genes such as for G418, gentamycin, neomycin, hygromycin or tetracycline resistance.

Using standard methods, it is possible to clone a gene of interest into one of the above-described shuttle vectors and to introduce such hybrid vectors into the microorganism strains used in the inventive process. The transformation of *Saccharomyces* can be achieved for example by LiCl or sheroplast transformation (Bishop et al., Mol. Cell. Biol., 6, 1986: 3401-3409; Sherman et al., Methods in Yeasts in Genetics, [Cold Spring Harbor Lab. Cold Spring Harbor, N.Y.] 1982, Agatep et al., Technical Tips Online 1998, 1:51: P01525 or Gietz et al., Methods Mol. Cell. Biol. 5, 1995: 255-269) or electroporation (Delorme E., Appl. Environ. Microbiol., vol. 55, no. 9, 1989: 2242-2246).

If the transformed sequence(s) is/are to be integrated advantageously into the genome of the microorganism used in the inventive process for example into the yeast or fungi genome, standard techniques known to the skilled worker also exist for this purpose. Solinger et al. (Proc Natl Acad Sci U.S.A., 2001 (15): 8447-8453) and Freedman et al. (Genetics, Vol. 162, 15-27, September 2002) teaches a homolog recombination system dependent on rad 50, rad51, rad54 and rad59 in yeasts. Vectors using this system for homologous recombination are vectors derived from the YIp series. Plasmid vectors derived for example from the 2µ-Vector are known by the skilled worker and used for the expression in yeasts. Other preferred vectors are for example pART1, pCHY21 or pEVP11 as they have been described by McLeod et al. (EMBO J. 1987, 6:729-736) and Hoffman et al. (Genes Dev. 5, 1991: 561-571.) or Russell et al. (J. Biol. Chem. 258, 1983: 143-149.). Other beneficial yeast vectors are plasmids of the REP, REP-X, pYZ or RIP series.

Example 5

Determining the Expression of the Mutant/Transgenic Protein

The observations of the activity of a mutated, or transgenic, protein in a transformed host cell are based on the fact that the protein is expressed in a similar manner and in a similar quantity as the wild-type protein. A suitable method for determining the transcription quantity of the mutant, or transgenic, gene (a sign for the amount of mRNA which is available for the translation of the gene product) is to carry out a Northern blot (see, for example, Ausubel et al., (1988) Current Protocols in Molecular Biology, Wiley: N.Y.), where a primer which is designed in such a way that it binds to the gene of interest is provided with a detectable marker (usually a radioactive or chemiluminescent marker) so that, when the total RNA of a culture of the organism is extracted, separated on a gel, applied to a stable matrix and incubated with this probe, the binding and quantity of the binding of the probe indicates the presence and also the amount of mRNA for this gene. Another method is a quantitative PCR. This information detects the extent to which the gene has been transcribed. Total cell RNA can be isolated for example from yeasts or *E. coli* by a variety of methods, which are known in the art, for example with the Ambion kit according to the instructions of the manufacturer or as described in Edgington et al., Promega Notes Magazine Number 41, 1993, p. 14.

Standard techniques, such as Western blot, may be employed to determine the presence or relative amount of protein translated from this mRNA (see, for example, Ausubel et al. (1988) "Current Protocols in Molecular Biology", Wiley, N.Y.). In this method, total cell proteins are extracted, separated by gel electrophoresis, transferred to a matrix such as nitrocellulose and incubated with a probe, such as an antibody, which binds specifically to the desired protein. This probe is usually provided directly or indirectly with a chemiluminescent or colorimetric marker, which can be detected readily. The presence and the observed amount of marker indicate the presence and the amount of the sought mutant protein in the cell. However, other methods are also known.

Example 6

Growth of Genetically Modified Organism: Media and Culture Conditions

Genetically modified Yeast, *Mortierella* or *Escherichia coli* are grown in synthetic or natural growth media known by the skilled worker. A number of different growth media for Yeast, *Mortierella* or *Escherichia coli* are well known and widely available. A method for culturing *Mortierella* is disclosed by Jang et al. [Bot. Bull. Acad. Sin. (2000) 41: 41-48]. *Mortierella* can be grown at 20° C. in a culture medium containing: 10 g/l glucose, 5 g/l yeast extract at pH 6.5. Furthermore Jang et al. teaches a submerged basal medium containing 20 g/l soluble starch, 5 g/l Bacto yeast extract, 10 g/l $KNO_3$, 1 g/l $KH_2PO_4$, and 0.5 g/l $MgSO_4.7H_2O$, pH 6.5.

Said media, which can be used according to the invention usually consist of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars may also be added to the media via complex compounds such as molasses or other by-products of sugar refining. It may also be advantageous to add mixtures of various carbon sources. Other possible carbon sources are alcohols and/or organic acids such as methanol, ethanol, acetic acid or lactic acid. Nitrogen sources are usually organic or inorganic nitrogen compounds or materials containing said compounds. Examples of nitrogen sources include ammonia gas, aqueous ammonia solutions or ammonium salts such as $NH_4Cl$, or $(NH_4)_2SO_4$, $NH_4OH$, nitrates, urea, amino acids or complex nitrogen sources such as cornsteep liquor, soybean flour, soybean protein, yeast extract, meat extract and others. Mixtures of the above nitrogen sources may be used advantageously.

Inorganic salt compounds, which may be included in the media comprise the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechulate or organic acids such as citric acid. The media usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the compounds used in the media depends heavily on the particular experiment and is decided upon individually for each specific case. Information on the optimization of media can be found in the textbook "Applied Microbiol. Physiology, A Practical Approach" (Ed. P. M. Rhodes, P. F. Stanbury, IRL Press (1997) S. 53-73, ISBN 0 19 963577 3). Growth media can also be obtained from commercial suppliers, for example Standard 1 (Merck) or BHI (Brain heart infusion, DIFCO) and the like.

All media components are sterilized, either by heat (20 min at 1.5 bar und 121° C.) or by filter sterilization. The components may be sterilized either together or, if required, separately. All media components may be present at the start of the cultivation or added continuously or batchwise, as desired.

The culture conditions are defined separately for each experiment. The temperature is normally between 15° C. and 45° C. and may be kept constant or may be altered during the experiment. The pH of the medium should be in the range from 5 to 8.5, preferably around 7.0, and can be maintained by adding buffers to the media. An example of a buffer for this purpose is a potassium phosphate buffer. Synthetic buffers such as MOPS, HEPES, ACES and the like may be used as an alternative or simultaneously. The culture pH value may also be kept constant during the culture period by addition of, for example, NaOH or $NH_4OH$. If complex media components such as yeast extract are used, additional buffers are required less since many complex compounds have a high buffer capacity. When using a fermenter for the culture of microorganisms, the pH value can also be regulated using gaseous ammonia.

The incubation period is generally in a range of from several hours to several days. This time period is selected in such a way that the maximum amount of product accumulates in the fermentation broth. The growth experiments, which are disclosed can be carried out in a multiplicity of containers such as microtiter plates, glass tubes, glass flasks or glass or metal fermenters of various sizes. To screen a large number of clones, the microorganisms should be grown in microtiter plates, glass tubes or shake flasks, either using simple flasks or baffle flasks. 100 ml shake flasks filled with 10% (based on the volume) of the growth medium required are preferably used. The flasks should be shaken on an orbital shaker (amplitude 25 mm) at a rate ranging from 100 to 300 rpm. Evaporation losses can be reduced by maintaining a humid atmosphere; as an alternative, a mathematical correction should be carried out for the evaporation losses.

If genetically modified clones are examined, an unmodified control clone, or a control clone, which contains the basic plasmid without insertion, should also be included in the tests. If a transgenic sequence is expressed, a control clone should advantageously again be included in these tests. The medium is advantageously inoculated to an OD600 of 0.5 to 1.5 using cells which have been grown on agar plates, such as CM plates (10 g/l glucose, 2.5 g/l NaCl, 2 g/l urea, 10 g/l polypeptone, 5 g/l yeast extract, 5 g/l meat extract, 22 g/l agar, pH value 6.8 established with 2M NaOH), which have been incubated at 30° C. The media are inoculated for example by addition of a liquid preculture of seed organism such as *E. coli* or *S. cerevisiae*.

Example 7

Growth of Genetically Modified Algae: Media and Culture Conditions

Growing *Chlamydomonas*

*Chlamydomonas reinhardtii* is able to grow under various growth conditions. It is a unicellular algae. The cells of *Chlamydomonas reinhardtii* can be normally cultured autotrophically in the media mentioned below. Cells of *Chlamydomonas reinhardtii* can be cultivated at 25° C. under cool-white fluorescence light at 10.000 lux (120 µE $m^{-2}$ $S^{-1}$ photosynthetically active radiation) as described by Ghirardi et al., Appl. Biochem. Biotechnol. 63, 1997: 141-151 or Semin et al., Plant. Physiol., Vol. 131, 2003: 1756-1764.

*Chlamydomonas* Growth medium:

1 l growth medium is prepared by adding the following volumes of the stock solutions as mentioned below:
1 ml solution A
5 ml solution B
1 ml solution C
1 ml solution D
3 ml solution E
3 ml solution F
1 ml solution G
1 ml solution H

| | |
|---|---|
| A) Trace elements solution: | 1 g/l $H_3BO_3$ |
| | 1 g/l $ZnSO_4 \times 7\ H_2O$ |
| | 0.3 g/l $MnSO_4 \times H_2O$ |
| | 0.2 g/l $CoCl_2 \times 6\ H_2O$ |
| | 0.2 g/l $Na_2MoO_4 \times 2\ H_2O$ |
| | 0.04 g/l $CuSO_4$ |
| B) Na Citrate solution: | 10% w/v Na citrate $\times$ 2 $H_2O$ |
| C) Iron solution: | 1% w/v $FeCl_3 \times 6\ H_2O$ |
| D) Calcium solution: | 5.3% w/v $CaCl_2 \times H_2O$ |
| E) Magnesium solution: | 10% w/v $MgSO_4 \times 7\ H_2O$ |
| F) Ammonium solution: | 10% w/v $NH_4NO_3$ |
| G) Potassium solution: | 10% w/v $KH_2PO_4$ |
| H) Dipotassium solution | 10% w/v $K_2HPO_4$ |

Bristol's Soil Extract Medium:

Soil extract medium can generally be used for the growth of axenic and xenic algae cultures. The soil extract is prepared by adding a teaspoon of dry garden soil and a pinch of $CaCO_3$ to 200 ml distilled water and steaming said solution for approximately 2 h on two consecutive days. Afterwards the supernatant is decanted and added to the desired medium.

To 940 ml bristol's solution 40 ml of soil extract medium is added.

Bristol's Solution:

To 940 ml of distilled water, the following stock solutions are added:
10 ml $NaNO_3$ (25 g/l)

| | | |
|---|---|---|
| 10 ml | $NaNO_3$ | (25 g/l) |
| 10 ml | $CaCl_2 \times 2H_2O$ | (2.5 g/l) |
| 10 ml | $MgSO_4 \times 7H_2O$ | (7.5 g/l) |
| 10 ml | $K_2HPO_4$ | (7.5 g/l) |
| 10 ml | $KH_2PO_4$ | (17.5 g/l) |
| 10 ml | NaCl | (2.5 g/l) |

Amplification and cloning of DNA from *Chlamydomonas reinhardtii* The DNA can be amplified by the polymerase chain reaction (PCR) from *Chlamydomonas reinhardtii* by the method of Crispin A. Howitt (Howitt C A (1996) BioTechniques 21:32-34).

Methionine production in *Chlamydomonas reinhardtii*

The amino acid production can be analysed as mentioned above. The proteins and nucleic acids can be analysed as mentioned below.

Example 8

In-vitro Analysis of the Function of the Proteins Encoded by the Transformed Sequences The determination of the activities and kinetic parameters of enzymes is well known in the art. Experiments for determining the activity of a specific modified enzyme must be adapted to the specific activity of the wild-enzyme type, which is well within the capabilities of the skilled worker. Overviews of enzymes in general and specific details regarding the structure, kinetics, principles, methods, applications and examples for the determination of many enzyme activities can be found for example in the following literature: Dixon, M., and Webb, E. C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N. C., Stevens, L. (1982) Fundamentals of Enzymology. Oxford Univ. Press: Oxford; Boyer, P. D: Ed. (1983) The Enzymes, 3rd Ed. Academic Press, New York; Bisswanger, H. (1994) Enzymkinetik, 2nd Ed. VCH, Weinheim (ISBN 3527300325); Bergmeyer, H. U., Bergmeyer, J., Graβl, M. Ed. (1983-1986) Methods of Enzymatic Analysis, 3rd Ed. Vol. I-XII, Verlag Chemie: Weinheim; and Ullmann's Encyclopedia of Industrial Chemistry (1987) Vol. A9, "Enzymes", VCH, Weinheim, pp. 352-363.

Example 9

Analysis of the Effect of the Nucleic Acid Molecule on the Production of the Amino Acids The effect of the genetic modification in plants, fungi, algae, ciliates on the production of an amino acid can be determined by growing the modified microorganisms for example *Chlamydomonas reinhardtii* under suitable conditions (such as those described above) and analyzing the medium and/or the cellular components for the increased production of the amino acid. Such analytical techniques are well known to the skilled worker and encompass spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, pp. 89-90 and pp. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469-714, VCH: Weinheim; Belter, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; chapter 11, pp. 1-27, VCH: Weinheim; and Dechow, F. J. (1989) Separation and purification techniques in biotechnology, Noyes Publications).

In addition to the determination of the fermentation end product, other components of the metabolic pathways which are used for the production of the desired compound, such as intermediates and by-products, may also be analyzed in order to determine the total productivity of the organism, the yield and/or production efficiency of the compound. The analytical methods encompass determining the amounts of nutrients in the medium (for example sugars, hydrocarbons, nitrogen sources, phosphate and other ions), determining biomass composition and growth, analyzing the production of ordinary metabolites from biosynthetic pathways and measuring gases generated during the fermentation. Standard methods for these are described in Applied Microbial Physiology; A Practical Approach, P. M. Rhodes and P. F. Stanbury, Ed. IRL Press, pp. 103-129; 131-163 and 165-192 (ISBN: 0199635773) and the references cited therein.

Example 10

Purification of the Amino Acid

The amino acid can be recovered from cells or from the supernatant of the above-described culture by a variety of methods known in the art. For example, the culture supernatant is recovered first. To this end, the cells are harvested from the culture by slow centrifugation. Cells can generally be disrupted or lysed by standard techniques such as mechanical force or sonication. The cell debris is removed by centrifugation and the supernatant fraction, if appropriate together with the culture supernatant, is used for the further purification of the amino acid. However, it is also possible to process the supernatant alone if the amino acid is present in the supernatant in sufficiently high a concentration. In this case, the amino acid, or the amino acid mixture, can be purified further for example via extraction and/or salt precipitation or via ion-exchange chromatography.

If required and desired, further chromatography steps with a suitable resin may follow, the amino acid, but not many contaminants in the sample, being retained on the chromatography resin or the contaminants, but not the sample with the product (amino acid), being retained on the resin. If necessary, these chromatography steps may be repeated, using identical or other chromatography resins. The skilled worker is familiar with the selection of suitable chromatography resin and the most effective use for a particular molecule to be purified. The purified product can be concentrated by filtration or ultrafiltration and stored at a temperature at which maximum product stability is ensured. Many purification methods, which are not limited to the above purification method are known in the art. They are described, for example, in Bailey, J. E. & Ollis, D. F. Biochemical Engineering Fundamentals, McGraw-Hill: New York (1986).

Identity and purity of the amino acid isolated can be determined by standard techniques of the art. They encompass high-performance liquid chromatography (HPLC), spectroscopic methods, mass spectrometry (MS), staining methods, thin-layer chromatography, NIRS, enzyme assay or microbiological assays. These analytical methods are compiled in: Patek et al. (1994) Appl. Environ. Microbiol. 60: 133-140; Malakhova et al. (1996) Biotekhnologiya 11: 27-32; and Schmidt et al. (1998) Bioprocess Engineer. 19: 67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al.

Example 11

Cloning of the Inventive Sequences as Shown in Table I, Column 5 and 7 for the Expression in Plants Unless otherwise specified, standard methods as described in Sambrook et al., Molecular Cloning: A laboratory manual, Cold Spring Harbor 1989, Cold Spring Harbor Laboratory Press are used.

The inventive sequences as shown in table I, column 5 and 7 were amplified by PCR as described in the protocol of the Pfu Turbo or Herculase DNA polymerase (Stratagene).

The composition for the protocol of the Pfu Turbo or Herculase DNA polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Pfu Turbo or Herculase DNA polymerase. The amplification cycles were as follows:

1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C.

1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

The following adapter sequences were added to *Saccharomyces cerevisiae* ORF specific primers (see table IV) for cloning purposes:

```
i) forward primer:
5'-GGAATTCCAGCTGACCACC-3'     SEQ ID NO: 14615 ii) reverse primer:
5'-GATCCCCGGGAATTGCCATG-3'    SEQ ID NO: 14616
```

The following adapter sequences were added to *Escherichia coli* ORF specific primers for cloning purposes:

```
iii) forward primer:
5'-TTGCTCTTCC-3'              SEQ ID NO: 14609 iiii) reverse primer:
5'-TTGCTCTTCG-3':             SEQ ID NO: 14610
```

Therefore for amplification and cloning of *Saccharomyces cerevisiae* SEQ ID NO: 1, a primer consisting of the adaptor sequence i) and the ORF specific sequence SEQ ID NO: 159 and a second primer consisting of the adaptor sequence ii) and the ORF specific sequence SEQ ID NO: 160 were used.

Following this example every sequence disclosed in table I, column 5 can be cloned by fusing the adaptor sequences to the respective specific primers sequences as disclosed in table III, column 7.

Construction of binary vectors for targeting of expressed proteins to the plastids.

Figure 3:
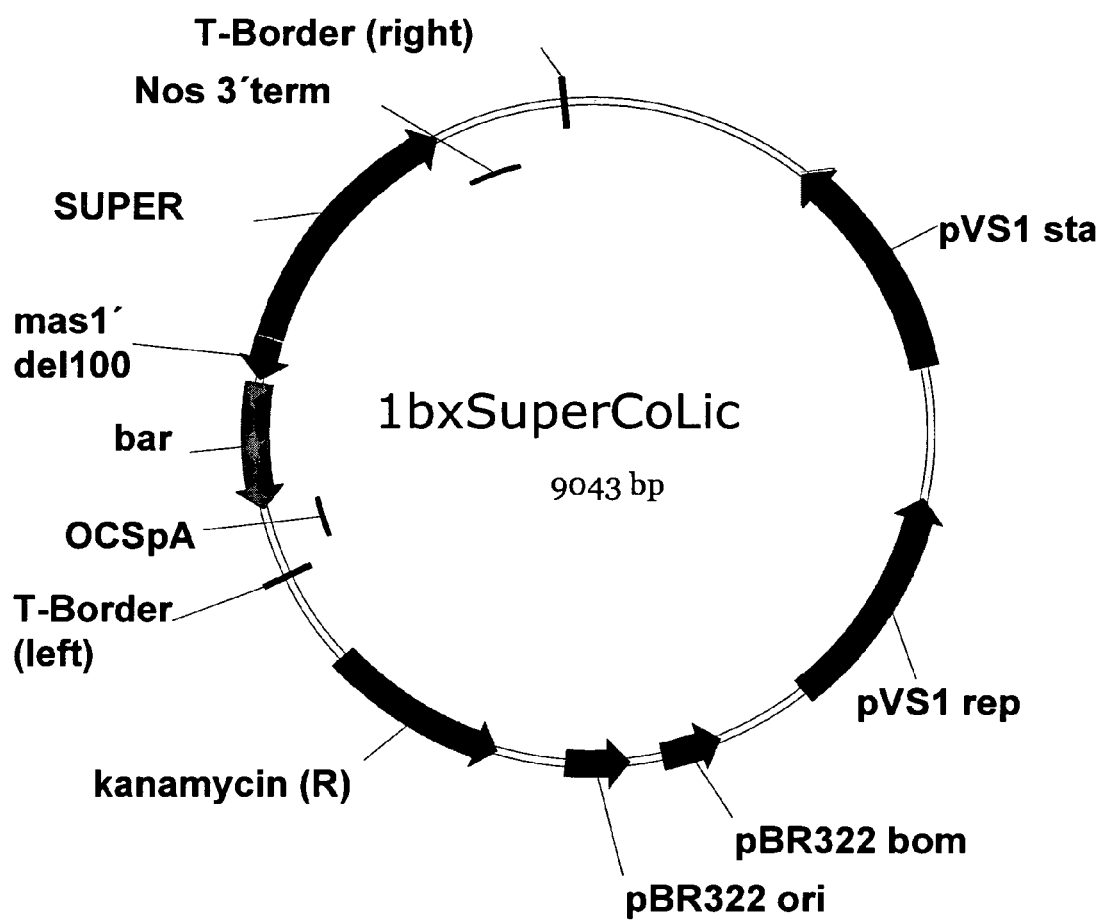
FIG. 3 depicts a vector map of the binary vector 1bxSuper-CoLic (SEQ ID NO: 14585).
Figure 4:
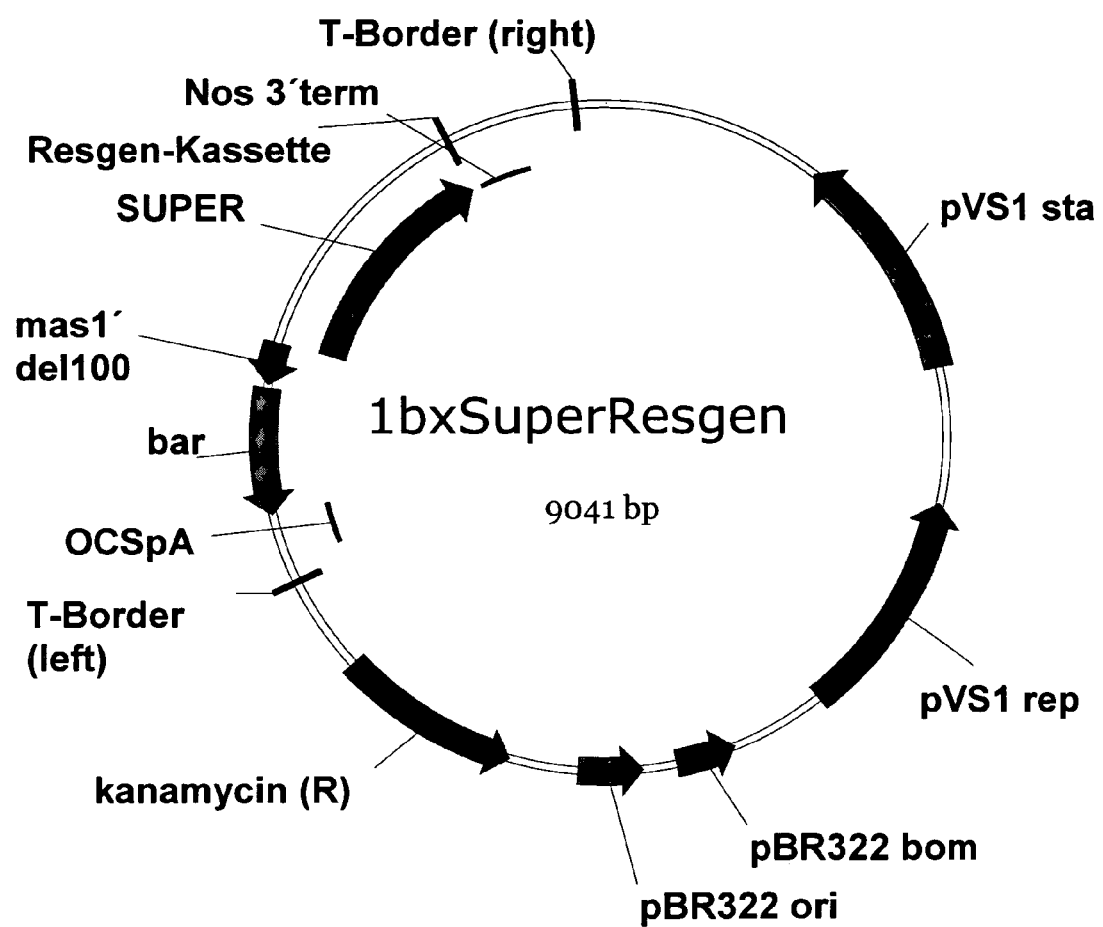
FIG. 4 depicts a vector map of the binary vector 1bxSuper-Resgen (SEQ ID NO: 14586).

The binary vectors used for cloning the targeting sequence were 1bxSuperResgen SEQ ID NO: 14586 (FIG. 4), and 1bxSuperColi SEQ ID NO: 14585 (FIG. 3). Other useful binary vectors are known to the skilled worker; an overview of binary vectors and their use can be found in Hellens, R., Mullineaux, P. and Klee H., [(2000) "A guide to *Agrobacterium* binary vectors", Trends in Plant Science, Vol. 5 No. 10, 446-451. Such vectors have to be equally equipped with appropriate promoters and targeting sequences.

Amplification of the targeting sequence of the gene FNR from *Spinacia oleracea*

In order to amplify the targeting sequence of the FNR gene from *S. oleracea*, genomic DNA was extracted from leaves of 4 weeks old *S. oleracea* plants (DNeasy Plant Mini Kit, Qiagen, Hilden). The gDNA was used as the template for a PCR.

To enable cloning of the transit sequence into the vector 1bxSuperResgen an EcoRI restriction enzyme recognition sequence was added to both the forward and reverse primers, whereas for cloning in the vectors 1bxSuperColi a PmeI restriction enzyme recognition sequence was added to the forward primer and a NcoI site was added to the reverse primer.

```
FNR5EcoResgen
ATA GAA TTC GCA TAA ACT TAT CTT    SEQ ID NO: 14613
CAT AGT TGC C FNR3EcoResgen
ATA GAA TTC AGA GGC GAT CTG GGC    SEQ ID NO: 14611
CCT FNR5PmeColic
ATA GTT TAA ACG CAT AAA CTT ATC    SEQ ID NO: 14614
TTC ATA GTT GCC FNR3NcoColic
ATA CCA TGG AAG AGC AAG AGG CGA    SEQ ID NO: 14612
TCT GGG CCC T
```

The sequence amplified from spinach SEQ ID NO: 14589 comprised a 5'UTR (bp1-167), and the coding region (bp 168-275 and 353-419). The coding sequence is interrupted by an intronic sequence from bp 276 to-bp 352.

```
                                              (see SEQ ID NO: 14589)
Gcataaacttatcttcatagttgccactccaatttgctccttgaatctcc tccaccaatacataatccactcctccatcacccacttcactactaaatc aaacttaactctgtttttctctctcctcctttcatttcttattcttccaa tcatcgtactccgccatgaccaccgctgtcaccgccgctgtttctttccc ctctaccaaaaccacctctctctccgcccgaagctcctccgtcatttccc ctgacaaaatcagctacaaaaaggtgattcccaatttcactgtgttttt attaataatttgttattttgatgatgagatgattaatttgggtgctgcag gttcctttgtactacaggaatgtatctgcaactgggaaaatgggaccat cagggcccagatcgcctct
```

The PCR fragment derived with the primers FNR5EcoResgen and FNR3EcoResgen was digested with EcoRI and ligated in the vector 1bxSuperResgen SeqIDxx that had also been digested with EcoRI. The correct orientation of the FNR targeting sequence was tested by sequencing. The vector generated in this ligation step was 1bxSuperTPFNRResgen.

The PCR fragment derived with the primers FNR5PmeColi and FNR3NcoColi was digested with PmeI and NcoI and ligated in the vector 1bxSuperColic (FIG. 3) SEQ ID NO: 14585 that had also been digested with PmeI and NcoI. The vector generated in this ligation step was 1bxSuperTPFNRColi.

For cloning the ORF of SEQ ID NO: 1, from *S. cerevisiae* the vector DNA was treated with the restriction enzyme NcoI. For cloning of ORFs from *E. coli* the vector DNA was treated with the restriction enzymes PacI and NcoI following the standard protocol (MBI Fermentas). The reaction was stopped by inactivation at 70° C. for 20 minutes and purified over QIAquick columns following the standard protocol (Qiagen).

Then the PCR-product representing the amplified ORF and the vector DNA was treated with T4 DNA polymerase according to the standard protocol (MBI Fermentas) to produce single stranded overhangs with the parameters 1 unit T4 DNA polymerase at 37° C. for 2-10 minutes for the vector and 1 u T4 DNA polymerase at 15° C. for 10-60 minutes for the PCR product representing SEQ ID NO: 1.

The reaction was stopped by addition of high-salt buffer and purified over QIAquick columns following the standard protocol (Qiagen).

According to this example the skilled person is able to clone all sequences disclosed in table I, column 5.

Approximately 30 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4° C.

The ligated constructs were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with 0.05 mg/ml kanamycine and incubated overnight at 37° C.

The outcome of the cloning step was verified by amplification with the aid of primers which bind upstream and downstream of the integration site, thus allowing the amplification of the insertion. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) supplemented with kanamycin ( ) and incubated overnight at 37° C.

The plasmid preparation was carried out as specified in the Qiaprep standard protocol (Qiagen).

Example 12

Generation of Transgenic Plants which Express SEQ ID NO: 1 or Any Other Sequence Disclosed in Table I, Column 5

1-5 ng of the plasmid DNA isolated was transformed by electroporation into competent cells of *Agrobacterium tumefaciens*, of strain GV 3101 pMP90 (Koncz and Schell, Mol. Gen. Gent. 204, 383-396, 1986). Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, e.g. rifampicine (0.1 mg/ml), gentamycine (0.025 mg/ml and kanamycine (0.05 mg/ml) and incubated for 48 hours at 28° C.

The agrobacteria that contains the plasmid construct were then used for the transformation of plants.

A colony was picked from the agar plate with the aid of a pipette tip and taken up in 3 ml of liquid TB medium, which also contained suitable antibiotics as described above. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E. V., Germany). The dishes were watered overnight with 0.05% Proplant solution (Chimac-Apriphar, Belgium). *Arabidopsis thaliana* C24 seeds (Nottingham *Arabidopsis* Stock Centre, UK; NASC Stock N906) were scattered over the dish, approximately 1000 seeds per dish. The dishes were covered with a hood and placed in the stratification facility (8 h, 110 µmol/m$^2$/s$^{-1}$, 22° C.; 16 h, dark, 6° C.). After 5 days, the dishes were placed into the short-day controlled environment chamber (8 h 130 µmol/m$^2$/s$^{-1}$, 22° C.; 16 h, dark 20° C.), where they remained for approximately 10 days until the first true leaves had formed.

The seedlings were transferred into pots containing the same substrate (Teku pots, 7 cm, LC series, manufactured by Pöppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 µE, 22° C.; 8 h, dark, 20° C.), where they were allowed to grow for further 17 days.

For the transformation, 6-week-old *Arabidopsis* plants, which had just started flowering were immersed for 10 seconds into the above-described agrobacterial suspension which had previously been treated with 10 µl Silwett L77 (Crompton S. A., Osi Specialties, Switzerland). The method in question is described in Clough and Bent, 1998 (Clough, J C and Bent, A F. 1998 Floral dip: a simplified method for *Agrobacterium*-mediated transformation of *Arabidopsis thaliana*, Plant J. 16:735-743.

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. Since the vector contained the bar gene as the resistance marker, plantlets were sprayed four times at an interval of 2 to 3 days with 0.02% BASTA® and transformed plants were allowed to set seeds. The seeds of the transgenic *A. thaliana* plants were stored in the freezer (at −20° C.).

Example 13

Plant Culture (*Arabidopsis*) for Bioanalytical Analyses

For the bioanalytical analyses of the transgenic plants, the latter were grown uniformly a specific culture facility. To this end the GS-90 substrate as the compost mixture was introduced into the potting machine (Laible System GmbH, Singen, Germany) and filled into the pots. Thereafter, 35 pots were combined in one dish and treated with Previcur. For the treatment, 25 ml of Previcur were taken up in 10 l of tap water. This amount was sufficient for the treatment of approximately 200 pots. The pots were placed into the Previcur solution and additionally irrigated overhead with tap water without Previcur. They were used within four days.

For the sowing, the seeds, which had been stored in the refrigerator (at −20° C.), were removed from the Eppendorf tubes with the aid of a toothpick and transferred into the pots with the compost. In total, approximately 5 to 12 seeds were distributed in the middle of the pot.

After the seeds had been sown, the dishes with the pots were covered with matching plastic hood and placed into the stratification chamber for 4 days in the dark at 4° C. The humidity was approximately 90%. After the stratification, the test plants were grown for 22 to 23 days at a 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 μE/m2/s−1.

When the plants were 8, 9 and 10 days old, they were subjected to selection for the resistance marker. Approximately pots with transgenic plants were treated with 1 l 0.015% vol/vol of Basta® (Glufosinate-ammonium) solution in water (Aventis Cropsience, Germany). After a further 3 to 4 days, the transgenic, resistant seedlings (plantlets in the 4-leaf stage) could be distinguished clearly from the untransformed plantlets. The nontransgenic seedlings were bleached or dead. The transgenic resistance plants were thinned when they had reached the age of 14 days. The plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 23 days, they were harvested.

Example 14

Metabolic Analysis of Transformed Plants

The modifications identified in accordance with the invention, in the content of above-described metabolites, were identified by the following procedure.

a) Sampling and Storage of the Samples

Sampling was performed directly in the controlled-environment chamber. The plants were cut using small laboratory scissors, rapidly weighed on laboratory scales, transferred into a pre-cooled extraction sleeve and placed into an aluminum rack cooled by liquid nitrogen. If required, the extraction sleeves can be stored in the freezer at −80° C. The time elapsing between cutting the plant to freezing it in liquid nitrogen amounted to not more than 10 to 20 seconds.

b) Lyophilization

During the experiment, care was taken that the plants either remained in the deep-frozen state (temperatures <−40° C.) or were freed from water by lyophilization until the first contact with solvents.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and a-methylglucopyranoside and methyl nonadecanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at at least 1400 g in order to accelerate phase separation. 1 ml of the supernatant methanol/water phase ("polar phase", colorless) was removed for the further GC analysis, and 1 ml was removed for the LC analysis. The remainder of the methanol/water phase was discarded. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

D) Processing the Lipid Phase for the LC/MS or LC/MS/MS Analysis, Processing of the Polar Phase for the LC/MS or LCMS/MS Analysis The lipid extract, which had been evaporated to dryness was taken up in mobile phase. The HPLC was run with gradient elution.

The polar extract, which had been evaporated to dryness was taken up in mobile phase. The HPLC was run with gradient elution.

The LC part was carried out on a commercially available LCMS system from Agilent Technologies, USA. For polar extracts 10 μl are injected into the system at a flow rate of 200 μl/min. The separation column (Reversed Phase C18) was maintained at 15° C. during chromatography. For lipid extracts 5 μl are injected into the system at a flow rate of 200 μl/min. The separation column (Reversed Phase C18) was maintained at 30° C. HPLC was performed with gradient elution.

The mass spectrometric analysis was performed on a Applied Biosystems API 4000 triple quadrupole instrument with turbo ion spray source. For polar extracts the instrument measures in negative ion mode in fullscan mode from 100-1000 amu. For lipid extracts the instrument measures in postive ion mode in fullscan mode from 100-1000 amu.

E) Derivatization of the Lipid Phase for the GC/MS Analysis

For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (5 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N(trimethylsilyl)-2,2,2-trifluoroacetamide (MSTFA) was carried out for 30 minutes at 60° C., again in the tightly sealed vessel. The final volume before injection into the GC was 220 µl.

F) Derivatization of the Polar Phase for the GC/MS Analysis and GC/MS Analysis

The methoximation of the carbonyl groups was carried out by reaction with methoxyamine hydrochloride (5 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

The GC-MS systems consist of an Agilent 6890 GC coupled to an Agilent 5973 MSD. The autosamplers are CompiPal or GCPal from CTC. For the analysis usual commercial capillary separation columns (30 m×0.25 mm×0.25 µm) with different polymethyl-siloxane stationary phases containing 0% up to 35% of aromatic moieties, depending on the analysed sample materials and fractions from the phase separation step, are used (for example: DB-1 ms, HP-5 ms, DB-XLB, DB-35 ms, Agilent Technologies). Up to 1 µL of the final volume is injected splitless and the oven temperature program is started at 70° C. and ended at 340° C. with different heating rates depending on the sample material and fraction from the phase separation step in order to achieve a sufficient chromatographic separation and number of scans within each analyte peak. Usual GC-MS standard conditions, for example constant flow with nominal 1 to 1.7 ml/min. and helium as the mobile phase gas are used. Ionisation is done by electron impact with 70 eV, scanning within a m/z range from 15 to 600 with scan rates from 2.5 to 3 scans/sec and standard tune conditions.

g) Analysis of the Various Plant Samples

The samples were measured in individual series of 20 plant samples each (also referred to as sequences), each sequence containing at least 5 wild-type plants as controls. The peak area of each analyte was divided by the peak area of the respective internal standard. The data were standardized for the fresh weight established for the plant. The values calculated thus were related to the wild-type control group by being divided by the mean of the corresponding data of the wild-type control group of the same sequence. The values obtained were referred to as ratio_by_WT, they are comparable between sequences and indicate how much the analyte concentration in the mutant differs in relation to the wild-type control. Appropriate controls were done before to proof that the vector and transformation procedure itself has no significant influence on the metabolic composition of the plants. Therefore the described changes in comparison with wild-types were caused by the introduced genes.

As an alternative, the amino acids can be detected advantageously via HPLC separation in ethanolic extract as described by Geigenberger et al. (Plant Cell & Environ, 19, 1996: 43-55).

The results of the different plant analyses can be seen from the table, which follows:

TABLE VI

| ORF | Metabolite | Method | Min | Max |
|---|---|---|---|---|
| b2827 | methionine | LC | 1.47 | 1.51 |
| YEL046c | methionine | GC + LC | 1.70 | 4.28 |
| YGR255C | methionine | GC | 1.36 | 3.92 |
| YGR289C | methionine | GC | 1.24 | 1.36 |
| YKR043C | methionine | LC | 1.37 | 1.58 |
| YLR153C | methionine | GC | 1.29 | 2.17 |

Column 1 shows the identified ORF, Column 2 shows the metabolite analyzed. Columns 4 and 5 show the ratio of the analyzed metabolite such as the amino acid between the transgenic plants and the wild type; Increase of the metabolites: Max: maximal x-fold (normalized to wild type)-Min: minimal x-fold (normalized to wild type). Decrease of the metabolites: Max: maximal x-fold (normalized to wild type) (minimal decrease), Min: minimal x-fold (normalized to wild type) (maximal decrease). Column 3 indicates the analytical method.

When the analyses were repeated independently, all results proved to be significant.

Example 15a

Engineering Ryegrass Plants by Over-expressing YGR255c from *Saccharomyces cerevisiae* or Homologs of YGR255c from Other Organisms Seeds of several different ryegrass varieties can be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled $H_2O$, and then germinated for 3-4 days on moist, sterile filter paper in the dark. Seedlings are further sterilized for 1 minute with 1% Tween-20, 5 minutes with 75% bleach, and rinsed 3 times with dd$H_2O$, 5 minutes each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collected the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter a appropriate targeting sequence and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 µm in size) are coated with plasmid DNA according to method of Sanford et al., 1993 and are delivered to the embryogenic callus with the following parameters: 500 µg particles and 2 µg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L Kanamycin. Shoots resistant to the selection agent are appearing and once rooted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

Example 15b

Engineering Soybean Plants by Over-expressing YGR255c from *Saccharomyces cerevisiae* or Homologs of YGR255c from Other Organisms Soybean can be transformed according to the following modification of the method described in the Texas A&M patent U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 µE-m-2s-1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used as described above, including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene to provide constitutive, developmental, tissue or environmental regulation of gene transcription as described above. In this example, the 34S promoter (GenBank Accession numbers M59930 and X16673) is used to provide constitutive expression of the trait gene. For plastidal expression a nucleic acid encoding an appropiate targeting sequence (see for example SEQ ID NO: 14590 to 14608) need to be inserted 5' to ORF in a way similar as described in example 11 in order to express a functional preprotein which is directed to the plastids.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

Example 15c

Engineering Corn Plants by Over-Expressing YGR255c from *Saccharomyces cerevisiae* or Homologs of YGR255c from Other Organisms Amplification of SEQ ID NO: 1 was achieved as described in example 11 except that the upstream primer SEQ ID NO: 159 and the reverse primer SEQ ID NO: 160 contained the following 5'extensions:

```
i) forward primer:
5'- GGGTCGCTCCTACGCG-3'      SEQ ID NO: 14619 ii) reverse primer
5'- CTCGGGCTCGGCGTCC-3'      SEQ ID NO: 14620
```

The maize transformation vector for plastidial targeting was constructed as follows. In order to amplify the targeting sequence of the rbcS gene from Z. maize, total RNA was extracted from leaves of 4 weeks old *Z. maize* plants (RNeasy Plant Mini Kit, Qiagen, Hilden). The RNA was transcribed in cDNA using SuperScript III First Strand Synthesis System from Invitrogen (Karlsruhe). The cDNA was used as template for a PCR.

Figure 2:
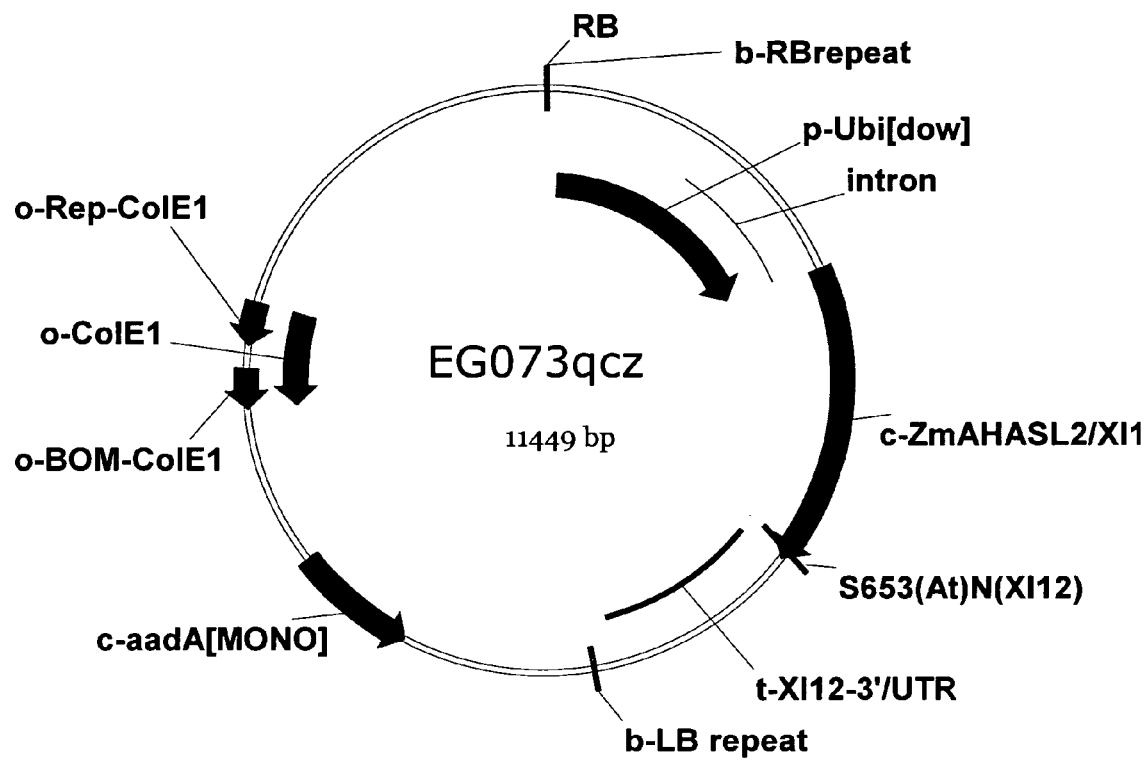
FIG. 2 depicts a vector map of vector EG073qcz (SEQ ID NO: 14588).

To enable cloning of the nucleic acid encoding the transitpeptide into the vector EG065PoccLic (SEQ ID NO: 14587, FIG. 1) and subsequently in EG073qcz (SEQ ID NO: 14588, FIG. 2) XmaI restriction enzyme recognition sequence were added to both the forward and reverse primer.

```
ZmTPrbcs5xma
ATACCCGGGATGGCGCCCACCGTGATGATG    SEQ ID NO: 14618

ZmTPrbcs3xma
ATACCCGGGCACCGGATCCTTCCGCCGTTG    SEQ ID NO: 14617
```

The PCR fragment was digested with XmaI and ligated in the vector EG065PoccLic (FIG. 1) that had also been digested with XmaI. The correct orientation of the rbcS targeting sequence was tested by sequencing. The vector generated in this ligation step was EG065PoccLicTPrbcS.

From the vector EG065PoccLicTPrbcS the expression cassette comprising the ScBV promoter, transit sequence and NOS terminator was cut out with the restriction enzymes AscI and PacI and ligated into the vector EG073qcz (FIG. 2) that had also been digested with AscI and PacI yielding the vector pMTX0584.

Cloning of the ORF SEQ ID NO: 1 into vector pMTX0584 was achieved as described in example 11 except the restriction enzymes MluI and SacII were used to open the vector.

According to the disclosure of this example a person skilled in the art is able to clone all other sequences mentioned in table I, column 5.

Corn Transformation

The preparation of the immature embryos and *Agrobacterium* were basically as stated in U.S. Pat. No. 5,591,616. In brief, the *Agrobacterium* strain LBA4404 transformed with the plasmid by a standard method, such as the triple cross method or the electroporation, was grown on LB plates for 2 days prior to cocultivation. A loop of cells was resuspended in liquid infection media at an O.D. of approximately 1.0. Immature Embryos of about 1.5 mm in size were incubated in the soln of agrobacterium for around 30 minutes. Excised embryos were removed from liquid and then co-cultivated in the dark at 22° C. with *Agrobacterium tumefacians* on solid MS-based callus induction medium containing 2 mg/l 2,4-D, 10 um AgNO3, and 200 um Acetosyringone. After several days of co-cultivation, embryos were transferred to MS-based media containing 2 mg/l 2,4, 10 um AgNO3 and 200 mg/l Timentin the dark at 27° C. for 1 week. Embryos were transferred to MS-based selection media containing imidazoline herbicide (500 nM Pursuit) as a selection agent in the dark for 3 weeks. After 3 weeks putative transgenic events were transferred to an MS-based media containing 2 mg/L Kinetin 500 nM Pursuit, 200 mg/l Timentin and incubated under cool white fluorescent light (100 uE/m2/s-1 with photoperiod of 16 hrs) at 25° C. for 2-3 weeks, or until shoots develop. The shoots were transferred to MS-based rooting medium and incubated under light at 25° C. for 2 weeks. The rooted shoots were transplanted to 4 inch pots containing artificial soil mix. Metro-Mix® 360 in and grown in an environmental chamber for 1-2 weeks. The environmental chamber maintained 16-h-light, 8-h-dark cycles at 27° C. day and 22° C. respectively. Light was supplied by a mixture of incandescent and cool white fluorescent bulbs with an intensity of ~400 uE/m2/s-1. After plants were grown to 4-6 leaf stage they were moved to 14 inch pots containing Metro-Mix® 360. Supplemental metalhalide lamps were used to maintain >800 uE/m2/s-1 with a 16-h-light, 8-h-dark cycles at 28° C. day and 22° C. Transplantation occurs weekly on Tuesday. Peters 20-20-20 plus micronutrients (200 ppm) is used to fertilize plants 2× weekly on Monday and Thursday after sampling of T0's is performed. T1 seeds were produced from plants that exhibit tolerance to the imidazolinone herbicides and which are PCR positive for the transgenes. T0 plants with single locus insertions of the T-DNA (self-pollinated) produced T1 generation that segregated for the transgene in a 3:1 ratio. Progeny containing copies of the transgene were tolerant of imidazolinone herbicides and could be detected by PCR analysis.

T0 plants with single locus insertions of the T-DNA (self-pollinated) produce T1 generation that can segregate for the transgene in a 3:1 ratio. Progeny containing copies of the transgene are tolerant of imidazolinone herbicides and can be detected by PCR analysis.

Growth of T0 Corn Plants for Metabolic Analysis

Plants are grown under the following standardized conditions to properly stage them for T0 sampling. T0 plantlets are transferred to 14" pots in the greenhouse after they grow to 4-6 leaf stage (1-3 weeks). pBSMM232 containing plants are produced carried along with each experiment to serve as controls for T0 samples. Plantlets are moved to 14" die Zeichen besser ausschreiben pots on Tuesday of each week. Plants are grown for 9 days until the 7-13 leaf stage is reached. On Thursday between 10 am and 2 pm leaf sampling is performed on the 3rd youngest ($1^{st}$ fully elongated). Within 30 seconds 250-500 mg of leaf material (without midrib), are removed weighed and placed into preextracted glass thimbles in liquid nitrogen. A second sample (opposite side of the midrib) from each plant is sampled as described above for qPCR analysis.

Growth of T1 Corn Plant for Metabolic Analysis

For the bioanalytical analyses of the transgenic plants, the latter were grown uniformly in a specific culture facility. To this end the GS-90 substrate as the compost mixture was introduced into the potting machine (Laible System GmbH, Singen, Germany) and filled into the pots. Thereafter, 26 pots were combined in one dish and treated with Previcur. For the treatment, 25 ml of Previcur were taken up in 10 l of tap water. This amount was sufficient for the treatment of approximately 150 pots. The pots were placed into the Previcur solution and additionally irrigated overhead with tap water without Previcur. They were used within four days.

For the sowing, the seeds, which had been stored at room temperature were removed from the paper-bag and transferred into the pots with the soil. In total, approximately 1 to 3 seeds were distributed in the middle of the pot.

After the seeds had been sown, the dishes with the pots were covered with matching plastic hood and placed into growth chambers for 2 days. After this time the plastic hood was removed and plants were placed on the growth table and cultivated for 22 to 24 days under following growth conditions: 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s-1.

When the plants were 7 days old, they were subjected to select transgenic plants. For this purposes pieces of plant leaves were sampled and a PCR reaction with the respective primers for the transgene were performed. Plants exhibiting the transgen were used for the metabolic analysis. The non-transgenic seedlings were removed. The transgenic plants were thinned when they had reached the age of 18 days. The transgenic plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 24 days, they were harvested.

Metabolic analysis of maize leaves.

The modifications identified in accordance with the invention, in the content of above-described metabolites, were identified by the following procedure.

a) Sampling and Storage of the Samples

Sampling was performed in corridor next to the green house. The leaves were incised twice using small laboratory scissors and this part of the leave was removed manually from the middle rib. The sample was rapidly weighed on laboratory scales, transferred into a pre-cooled extraction sleeve and placed into kryo-box cooled by liquid nitrogen. The time elapsing between cutting the leave to freezing it in liquid nitrogen amounted to not more than 30 seconds. The boxes were stored in a freezer at −80° C., an shipped on dry ice.

b) Lyophilization

During the experiment, care was taken that the plants either remained in the deep-frozen state (temperatures <−40° C.) or were freed from water by lyophilization until the first contact with solvents. Before entering the analytical process the extraction sleeves with the samples were transferred to a pre-cooled aluminium rack.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nona-decanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at at least 1400 g in order to accelerate phase separation. 0.5 ml of the supernatant methanol/water phase ("polar phase", colorless) was removed for the further GC analysis, and 0.5 ml was removed for the LC analysis. The remainder of the methanol/water phase of all samples was used for additional quality controls. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

D) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

E) Derivatization of the Lipid Phase for the GC/MS Analysis

For the transmethanolysis, a mixture of 140 μl of chloroform, 37 μl of hydrochloric acid (37% by weight HCl in water), 320 μl of methanol and 20 μl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (20 mg/ml in pyridine, 100 μl for 1.5 hours at 60° C.) in a tightly sealed vessel. 20 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 μl of N-methyl-N-(trimethylsilyl)-2,2,2-trifluoroacetamide (MSTFA) was carried out for 30 minutes at 60° C., again in the tightly sealed vessel. The final volume before injection into the GC was 220 μl.

F) Derivatization of the Polar Phase for the GC/MS Analysis

The methoximation of the carbonyl groups was carried out by reaction with methoxyamine hydrochloride (20 mg/ml in pyridine, 50 μl for 1.5 hours at 60° C.) in a tightly sealed vessel. 10 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 μl of N-methyl-N-(trimethylsilyl)-2,2,2-trifluoroacetamide (MSTFA) was carried out for 30 minutes at 60° C., again in the tightly sealed vessel. The final volume before injection into the GC was 110 μl.

G) Analysis of the Various Plant Samples

The samples were measured in individual series of 20 plant (leaf) samples each (also referred to as sequences), each sequence containing at least 5 samples from individual control plants containing GUS. The peak area of each analyte was divided by the peak area of the respective internal standard. The data were standardized for the fresh weight established for the respective harvested sample. The values calculated were then related to the GUS-containing control group by being divided by the mean of the corresponding data of the control group of the same sequence. The values obtained were referred to as ratio_by_WT, they are comparable between sequences and indicate how much the analyte concentration in the mutant differs in relation to the control. The GUS-containing plants were chosen in order to assure that the vector and transformation procedure itself has no significant influence on the metabolic composition of the plants. Therefore the described changes in comparison with the controls were caused by the introduced genes.

Example 15d

Engineering Wheat Plants by Over-expressing YGR255c from *Saccharomyces cerevisiae* or Homologs of YGR255c from Other Organisms Transformation of wheat is performed with the method described by Ishida et al. (1996 Nature Biotech. 14745-50). The cultivar Bobwhite (available from CYMMIT, Mexico) is commonly used in transformation. Immature embryos are cocultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene. For plastidal expression a nucleic acid encoding an appropriate targeting sequence) need to be inserted 5' to ORF in a way similar as described in example 15c in order to express a functional preprotein which is directed to the plastids.

After incubation with *Agrobacterium*, the embryos are grown on callus induction medium, then regeneration medium, containing imidazolinone as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene are tolerant of the imidazolinone herbicide. Homozygous T2 plants exhibited similar phenotypes.

Example 15e

Engineering Rapeseed/Canola Plants by Over-expressing YGR255c from *Saccharomyces cerevisiae* or Homologs of YGR255c from Other Organisms Cotyledonary petioles and hypocotyls of 5-6 day-old young seedlings are used as explants for tissue culture and transformed according to Babic et al. (1998, Plant Cell Rep 17: 183-188). The commercial cultivar Westar (Agriculture Canada) is the standard variety used for transformation, but other varieties can be used.

*Agrobacterium tumefaciens* LBA4404 containing a binary vector are used for canola transformation. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium* tumefaciens. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene. For plastidal expression a nucleic acid encoding an appropriate targeting sequence (see for example SEQ ID NO: 14590 to 14608) need to be inserted 5' to ORF in a way similar as described in example 11 in order to express a functional preprotein which is directed to the plastids.

Canola seeds are surface-sterilized in 70% ethanol for 2 min., and then in 30% Clorox with a drop of Tween-20 for 10 min, followed by three rinses with sterilized distilled water. Seeds are then germinated in vitro 5 days on half strength MS medium without hormones, 1% sucrose, 0.7% Phytagar at 23° C., 16 hr. light. The cotyledon petiole explants with the cotyledon attached are excised from the in vitro seedlings, and are inoculated with *Agrobacterium* by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction.

Samples of the primary transgenic plants (T0) are analyzed by PCR to confirm the presence of T-DNA. These results are confirmed by Southern hybridization in which DNA is electrophoresed on a 1% agarose gel and are transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Example 15f

Engineering Alfalfa Plants by Over-Expressing YGR255c from *Saccharomyces cerevisiae* or Homologs of YGR255c from Other Organisms A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants are cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene. For plastidal expression a nucleic acid encoding an appropriate targeting sequence (see for example SEQ ID NO: 14590 to 14608) need to be inserted 5' to ORF in a way similar as described in example 11 in order to express a functional preprotein which is directed to the plastids.

The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII

TABLE VII

| ORF_NAME | Metabolite | MIN | MAX |
|---|---|---|---|
| YEL046C | Methionine | 1.48 | 2.10 |
| YGR255C | Methionine | 1.49 | 1.90 |
| YKR043C | Methionine | 2.78 | 3.67 |

Table VII shows the increase in methionine in genetically modified corn plants expressing the *Saccharomyces cerevisiae* nucleic acid sequences YEL046C, YGR255C and YKR043C.

In one embodiment, in case the activity of the *Saccharomyces cerevisiae* protein YEL046C or its homologs, e.g. a "L-threonine aldolase", is increased in corn plants, preferably, an increase of the fine chemical methionine between 48% and 110% is conferred.

In one embodiment, in case the activity of the *Saccharomyces cerevisiae* protein YGR255C or its homologs, e.g. a "putative flavin-dependent monooxygenase", is increased in corn plants, preferably, an increase of the fine chemical methionine between 49% and 90% is conferred.

In one embodiment, in case the activity of the *Saccharomyces cerevisiae* protein YKR043C or its homologs, e.g. a "unknown ORF", is increased in corn plants, preferably, an increase of the fine chemicals methionine between 178% and 267% or more is conferred.

Example 16

Preparation of Homologous Sequences from Plants

Different plants can be grown under standard or varying conditions in the greenhouse. RNA can be extracted following the protocol of Jones, Dunsmuir and Bedbrook (1985) EMBO J. 4: 2411-2418. Approx. 1 gram of tissue material from various organs is grounded in liquid nitrogen. The powder is transferred to a 13 ml Falcon tube containing 4.5 ml NTES buffer (100 mM NaCl, 10 mM Tris/HCl pH 7.5, 1 mM EDTA, 1% SDS; in RNase-free water) and 3 ml phenol/chloroform/isoamylalcohol (25/24/1), immediately mixed and stored on ice. The mixture is spun for 10 minutes at 7000 rpm using a centrifuge (Sorval; SM24 or SS34 rotor). The supernatant is transferred to a new tube, ⅒th volume of 3 M NaAcetate (pH 5.2; in RNase-free water) and 1 volume of isopropanol is added, mixed at stored for 1 hour or overnight at −20° C. The mixture is spun for 10 minutes at 7000 rpm. The supernatant is discarded and the pellet washed with 70% ethanol (v/v). The mixture is spun for 5 minutes at 7000 rpm, the supernatant is discarded and the pellet is air-dried. 1 ml RNase-free water is added and allows the DNA/RNA pellet to dissolve on ice at 4° C. The nucleic acid solution is transferred to a 2 ml Eppendorf tube and 1 ml of 4 M LiAcetate is added. After mixing the solution is kept for at least 3 hours, or overnight, at 4 C. The mixture is spun for 10 minutes at 14000 rpm, the supernatant discarded, the pellet washed with 70% Ethanol, air-dried and dissolved in 200 μl of RNase-free water.

Total RNA can be used to construct a cDNA-library according to the manufacturer's protocol (for example using the ZAP-cDNA synthesis and cloning kit of Stratagene, La Jolla, USA). Basically, messenger RNA (mRNA) is primed in the first strand synthesis with a oligo(dT) linker-primer and is reverse-transcribed using reverse transcriptase. After second strand cDNA synthesis, the double-stranded cDNA is ligated into the Uni-ZAP XR vector. The Uni-ZAP XR vector allows in vivo excision of the pBluescript phagemid. The polylinker of the pBluescript phagemid has 21 unique cloning sites flanked by T3 and T7 promoters and a choice of 6 different primer sites for DNA sequencing. Systematic single run sequencing of the expected 5 prime end of the clones can allow preliminary annotation of the sequences for example with the help of the pedant pro Software package (Biomax, Müinchen, Germany). Clones for the nucleic acids of the invention or used in the process according to the invention can be identified based on homology search with standard algorithms like blastp or gap. Identified putative full length clones with identity or high homology can be subjected to further sequencing in order to obtain the complete sequence.

Additional new homologous sequences can be identified in a similar manner by preparing respective cDNA libraries from various plant sources as described above. Libraries can then be screened with available sequences of the invention under low stringency conditions for example as described in Sambrook et al., Molecular Cloning: A laboratory manual, Cold Spring Harbor 1989, Cold Spring Harbor Laboratory Press. Purified positive clones can be subjected to the in vivo excision and complete sequencing. A pairwise sequence alignment of the original and the new sequence using the blastp or gap program allows the identification of orthologs, meaning homologous sequences from different organisms, which should have a sequence identity of at least 30%. Furthermore the conservation of functionally important amino acid residues or domains, which can be identified by the alignment of several already available paralogs, can identify a new sequence as a new orthologs.

Alternatively libraries can be subjected to mass sequencing and obtained sequences can be stored in a sequence database, which then can be screened for putative orthologs by different search algorithms, for example the tbastn algorithm to search the obtained nucleic acid sequences with a amino acid sequence of the invention. Clones with the highest sequence identity are used for a complete sequence determination and orthologs can be identified as described above.

Equivalents

Those skilled in the art will recognize, or will be able to ascertain using no more than routine experimentation, many equivalents to the specific embodiments of the invention described herein. Such equivalents are intended to be encompassed by the claims.

for the disclosure of the paragraphs [0001.0.0.1] to [0007.0.0.1] see paragraphs [0001.0.0.0] to [0007.0.0.0] above.

Following the aproach of deregulating specific enzymes in the amino acid biosynthetic pathway an increase of the levels of free threonine is disclosed in U.S. Pat. No. 5,942,660 which is achieved by overexpression of either a wild-type or deregulated aspartate kinase, homoserine dehydrogenase or threonine synthase.

for the disclosure of this paragraph see [0008.0.0.0] above.

As described above, the essential amino acids are necessary for humans and many mammals, for example for livestock. Threonine is an important constituent in many body proteins and is necessary for the formation of tooth enamel protein, collagen and elastin, which both needed for healthy skin and wound healing. It is a precursor to the amino acids glycine and serine. It acts as a lipotropic in controlling fat build-up in the liver. Threonine is an immune stimulant becouse it promotes thymus growth and activity. It is a component of digestive enzymes and immune secretions from the gut, particularly mucins. It has been used as a supplement to help alleviate anxiety and some cases of depression. In animal production, as an important essential amino acid, threonine is normally the second limiting amino acid for pigs and the third limiting amino acid for chicken (Gallus gallus f. domestica), e.g. laying hen or broiler.

for the disclosure of the paragraphs [0010.0.0.1] and [0011.0.0.1] see paragraphs [0010.0.0.0] and [0011.0.0.0] above.

It is an object of the present invention to develop an inexpensive process for the synthesis of threonine, preferably L-threonine. Threonine is with lysin and methionine (depending on the organism) one of the amino acids, which are most frequently limiting for the disclosure of this paragraph see [0013.0.0.0] above.

Accordingly, in a first embodiment, the invention relates to a process for the production of a fine chemical, whereby the fine chemical is threonine, preferably L-threonine. Accordingly, in the present invention, the term "the fine chemical" as used herein relates to "threonine". Further, the term "the fine chemicals" as used herein also relates to fine chemicals comprising threonine.

In one embodiment, the term "the fine chemical" means threonine, preferably L-threonine. Throughout the specification the term "the fine chemical" means threonine, preferably L-threonine, its salts, ester or amids in free form or bound to proteins. In a preferred embodiment, the term "the fine chemical" means threonine, preferably L-threonine in free form or its salts or bound to proteins.

Accordingly, the present invention relates to a process for the production of threonine, which comprises (a) increasing or generating the activity of a protein as shown in table II, application no. 2, column 3 encoded by the nucleic acid sequences as shown in table I, application no. 2, column 5, in an organelle of a microorganism or plant, or (b) increasing or generating the activity of a protein as shown in table II, application no. 2, column 3 encoded by the nucleic acid sequences as shown in table I, application no. 2, column 5 in the plastid of a microorganism or plant, or in one or more parts thereof; and (c) growing the organism under conditions which permit the production of the fine chemical, thus, threonine or fine chemicals comprising threonine, in said organism or in the culture medium surrounding the organism.

In another embodiment the present invention is related to a process for the production of threonine, which comprises a) increasing or generating the activity of a protein as shown in table II, application no. 2, column 3 encoded by the nucleic acid sequences as shown in table I, application no. 2, column 5, in an organelle of a non-human organism, or b) increasing or generating the activity of a protein as shown in table II, application no. 2, column 3 encoded by the nucleic acid sequences as shown in table I, application no. 2, column 5, which are joined to a nucleic acid sequence encoding a transit peptide in a non-human organism, or in one or more parts thereof; or c) increasing or generating the activity of a protein as shown in table II, application no. 2, column 3 encoded by the nucleic acid sequences as shown in table I, application no. 2, column 5, which are joined to a nucleic acid sequence encoding chloroplast localization sequence, in a non-human organism, or in one or more parts thereof, and d) growing the organism under conditions which permit the production of threonine in said organism.

In another embodiment, the present invention relates to a process for the production of threonine, which comprises (a) increasing or generating the activity of a protein as shown in table II, application no. 2, column 3 encoded by the nucleic acid sequences as shown in table I, application no.

2, column 5, in an organelle of a microorganism or plant through the transformation of the organelle, or (b) increasing or generating the activity of a protein as shown in table II, application no. 2, column 3 encoded by the nucleic acid sequences as shown in table I, application no. 2, column 5 in the plastid of a microorganism or plant, or in one or more parts thereof through the transformation of the plastids; and (c) growing the organism under conditions which permit the production of the fine chemical, thus, threonine or fine chemicals comprising threonine, in said organism or in the culture medium surrounding the organism.

Advantageously the activity of the protein as shown in table II, application no. 2, column 3 encoded by the nucleic acid sequences as shown in table I, application no. 2, column 5 is increased or generated in the abovementioned process in the plastid of a microorganism or plant.

for the disclosure of the paragraphs [0019.0.0.1] to [0024.0.0.1] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 2, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-tranlationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 2, column 3 and its homologs as disclosed in table I, application no. 2, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 2, column 3 and its homologs as disclosed in table I, application no. 2, columns 5 and 7.

for the disclosure of the paragraphs [0027.0.0.1] to [0029.0.0.1] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 2, columns 5 and 7. The person skilled in the art is able to join said sequences in a functional manner. Advantageously the transit peptide part is cleaved off from the protein part shown in table II, application no. 2, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein mentioned in table II, application no. 2, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 2, columns 5 and 7. In case of the amino acid sequence QIA CSS the three amino acids in front of the start methionine are stemming from the LIC (=ligation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 2, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 2, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 2, columns 5 and 7 are directly introduced and expressed in plastids.

in the context of this specification shall mean the insertion of a nucleic acid sequence into the organism by means of a "transfection", "transduction" or preferably by "transformation".

by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.1] and [0030.3.0.1] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 2, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 2, columns 5 and 7 or a sequence encoding a protein, as depicted in table II, application no. 2, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 2, columns 5 and 7 or a sequence encoding a protein, as depicted in table II, application no. 2, columns 5 and 7 in such a manner that the viroid sequence transports a sequence transcribed from a sequence as depicted in table I, application no. 2 columns 5 and 7 or a sequence encoding a protein as depicted in table II, application no. 2 columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 2, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 2, columns 5 and 7.

In a preferred embodiment of the invention the nucleic acid sequences as shown in table I, application no. 2, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 2, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.1] and [0032.0.0.1] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 2, column 3. Preferably the modification of the activity of a protein as shown in table II, application no. 2, column 3 or their combination can be achieved by joining the protein to a transit peptide.

Surprisingly it was found, that the transgenic expression of the *Saccaromyces cerevisiae* protein as shown in table II, application no. 2, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b0760 from *Escherichia coli* (Acession PIR: JC6038) has been published in Blattner et al., Science 277 (5331), 1453-1474 (1997), and its activity is being defined as "ATP-binding component of molybdate transport system". Accordingly, in one embodiment, the process of the present invention comprises the use of a "ATP-binding component of molybdate transport system" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b0760 protein is increased or generated, e.g. from *Escherichia coli* or a homolog thereof, preferably linked at least to one transit peptide as mentioned for example in table V.

In another embodiment, in the process of the present invention the activity of a b0760 protein is increased or generated in a subcellular compartment of the organism or organism cell such as in an organelle like a plastid or mitochondria.

The sequence of b1062 from *Escherichia coli* (Acession PIR:DEECOO) has been published in Blattner et al., Science 277 (5331), 1453-1474 (1997), and its activity is being defined as "dihydro-orotase". Accordingly, in one embodiment, the process of the present invention comprises the use of a "dihydro-orotase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b1062 protein is increased or generated, e.g. from *Escherichia coli* or a homolog thereof, preferably linked at least to one transit peptide as mentioned for example in table V.

In another embodiment, in the process of the present invention the activity of a b1062 protein is increased or generated in a subcellular compartment of the organism or organism cell such as in an organelle like a plastid or mitochondria.

The sequence of 1131 (Accession number NP_415649) from *Escherichia coli* has been published in Blattner et al., Science 277 (5331), 1453-1474 (1997), and its activity is being defined as "adenylosuccinate lyase". Accordingly, in one embodiment, the process of the present invention comprises the use of a "adenylosuccinate lyase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b1131 protein is increased or generated, e.g. from *Escherichia coli* or a homolog thereof, preferably linked at least to one transit peptide as mentioned for example in table V.

In another embodiment, in the process of the present invention the activity of a b1131 protein is increased or generated in a subcellular compartment of the organism or organism cell such as in an organelle like a plastid or mitochondria.

The sequence of b1264 (Accession number NP_415780) from *Escherichia coli* has been published in Blattner et al., Science 277 (5331), 1453-1474 (1997), and its activity is being defined as "anthranilate synthase component I". Accordingly, in one embodiment, the process of the present invention comprises the use of a "anthranilate synthase component I" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b1264 protein is increased or generated, e.g. from *Escherichia coli* or a homolog thereof, preferably linked at least to one transit peptide as mentioned for example in table V.

In another embodiment, in the process of the present invention the activity of a b1264 protein is increased or generated in a subcellular compartment of the organism or organism cell such as in an organelle like a plastid or mitochondria.

The sequence of b1277 from *Escherichia coli* (Acession PIR:A40654) has been published in Blattner et al., Science 277 (5331), 1453-1474 (1997), and its activity is being defined as "GTP cyclohydrolase 11". Accordingly, in one embodiment, the process of the present invention comprises the use of a "GTP cyclohydrolase II" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b1277 protein is increased or generated, e.g. from *Escherichia coli* or a homolog thereof, preferably linked at least to one transit peptide as mentioned for example in table V.

In another embodiment, in the process of the present invention the activity of a b1277 protein is increased or generated in a subcellular compartment of the organism or organism cell such as in an organelle like a plastid or mitochondria.

The sequence of b2040 from *Escherichia coli* (Acession PIR:G64969) has been published in Blattner et al., Science 277 (5331), 1453-1474 (1997), and its activity is being defined as "TDP-rhamnose synthetase, NAD(P)-binding". Accordingly, in one embodiment, the process of the present invention comprises the use of a "TDP-rhamnose synthetase, NAD(P)-binding" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b2040 protein is increased or generated, e.g. from *Escherichia coli* or a homolog thereof, preferably linked at least to one transit peptide as mentioned for example in table V.

In another embodiment, in the process of the present invention the activity of a b2040 protein is increased or generated in a subcellular compartment of the organism or organism cell such as in an organelle like a plastid or mitochondria.

The sequence of b2066 (Accession number NP_416570) from *Escherichia coli* has been published in Blattner et al., Science 277 (5331), 1453-1474 (1997), and its activity is being defined as "uridine/cytidine kinase". Accordingly, in one embodiment, the process of the present invention comprises the use of a "uridine/cytidine kinase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b2066 protein is increased or generated, e.g. from *Escherichia coli* or a homolog thereof, preferably linked at least to one transit peptide as mentioned for example in table V.

In another embodiment, in the process of the present invention the activity of a b2066 protein is increased or generated in a subcellular compartment of the organism or organism cell such as in an organelle like a plastid or mitochondria.

The sequence of b2388 from *Escherichia coli* (Acession PIR:A65013) has been published in Blattner et al., Science 277 (5331), 1453-1474 (1997), and its activity is being defined as "glucokinase". Accordingly, in one embodiment, the process of the present invention comprises the use of a "glucokinase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b2388 protein is increased or generated, e.g. from *Escherichia coli* or a homolog thereof, preferably linked at least to one transit peptide as mentioned for example in table V.

In another embodiment, in the process of the present invention the activity of a b2388 protein is increased or generated in a subcellular compartment of the organism or organism cell such as in an organelle like a plastid or mitochondria.

The sequence of b2779 (Accession number NP_417259) from *Escherichia coli* has been published in Blattner et al., Science 277 (5331), 1453-1474 (1997), and its activity is being defined as "enolase". Accordingly, in one embodiment, the process of the present invention comprises the use of a "enolase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b2779 protein is increased or generated, e.g. from *Escherichia coli* or a homolog thereof, preferably linked at least to one transit peptide as mentioned for example in table V.

In another embodiment, in the process of the present invention the activity of a b2779 protein is increased or generated in a subcellular compartment of the organism or organism cell such as in an organelle like a plastid or mitochondria.

The sequence of b3213 (Accession number NP_417680) from *Escherichia coli* has been published in Blattner et al., Science 277 (5331), 1453-1474 (1997), and its activity is being defined as "glutamate synthase" (small subunit, nucleotide-binding, 4Fe-4S protein). Accordingly, in one embodiment, the process of the present invention comprises the use of a "glutamate synthase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b3213 protein is increased or generated, e.g. from *Escherichia coli* or a homolog thereof, preferably linked at least to one transit peptide as mentioned for example in table V.

In another embodiment, in the process of the present invention the activity of a b3213 protein is increased or generated in a subcellular compartment of the organism or organism cell such as in an organelle like a plastid or mitochondria.

The sequence of b3429 (Accession number NP_417887) from *Escherichia coli* has been published in Blattner et al., Science 277 (5331), 1453-1474 (1997), and its activity is being defined as "glycogen synthase". Accordingly, in one embodiment, the process of the present invention comprises the use of a "glycogen synthase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b3429 protein is increased or generated, e.g. from *Escherichia coli* or a homolog thereof, preferably linked at least to one transit peptide as mentioned for example in table V.

In another embodiment, in the process of the present invention the activity of a b3429 protein is increased or generated in a subcellular compartment of the organism or organism cell such as in an organelle like a plastid or mitochondria.

The sequence of b3443 from *Escherichia coli* (Acession NP_417900) has been published in Blattner et al., Science 277 (5331), 1453-1474 (1997), and its activity is being defined as a "uncharacterized ORF". Accordingly, in one embodiment, the process of the present invention comprises the use of a "uncharacterized ORF" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b3443 protein is increased or generated, e.g. from *Escherichia coli* or a homolog thereof, preferably linked at least to one transit peptide as mentioned for example in table V.

In another embodiment, in the process of the present invention the activity of a b3443 protein is increased or generated in a subcellular compartment of the organism or organism cell such as in an organelle like a plastid or mitochondria.

The sequence of b4039 (Accession number PIR:S25660) from *Escherichia coli* has been published in Blattner et al., Science 277 (5331), 1453-1474 (1997), and its activity is being defined as "4-hydroxybenzoate synthetase". Accordingly, in one embodiment, the process of the present invention comprises the use of a "4-hydroxybenzoate synthetase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a b4039 protein is increased or generated, e.g. from *Escherichia coli* or a homolog thereof, preferably linked at least to one transit peptide as mentioned for example in table V.

In another embodiment, in the process of the present invention the activity of a b4039 protein is increased or generated in a subcellular compartment of the organism or organism cell such as in an organelle like a plastid or mitochondria.

The sequence of YDR430C from *Saccharomyces cerevisiae* (Accession PIR:S69711) has been published in Jacq et al., Nature 387 (6632 Suppl), 75-78, 1997 and Goffeau, Science 274 (5287), 546-547, 1996, and its activity is being defined as "metalloprotease". Accordingly, in one embodiment, the process of the present invention comprises the use of a "metalloprotease" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YDR430C protein is increased or generated, e.g. from *Saccharomyces cerevisiae* or a homolog thereof, preferably linked at least to one transit peptide as mentioned for example in table V.

In another embodiment, in the process of the present invention the activity of a YDR430C protein is increased or generated in a subcellular compartment of the organism or organism cell such as in an organelle like a plastid or mitochondria.

The sequence of YMR262W from *Saccharomyces cerevisiae* (Accession PIR:S54474) has been published in Bowman et al., Nature 387:90-93 (1997), and its activity is being defined as a "uncharacterized ORF". Accordingly, in one embodiment, the process of the present invention comprises the use of a "uncharacterized ORF" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YMR262W protein is increased or generated, e.g. from *Saccharomyces cerevisiae* or a homolog thereof, preferably linked at least to one transit peptide as mentioned for example in table V.

In another embodiment, in the process of the present invention the activity of a YMR262W protein is increased or generated in a subcellular compartment of the organism or organism cell such as in an organelle like a plastid or mitochondria.

The sequence of YOR350C (Accession number PIR|S67259) from *Saccharomyces cerevisiae* has been published in Dujon et al., Nature 387:98-102(1997), and its activity is being defined as "a protein, which is similar to *Lucilia illustris* mitochondria cytochrome oxidase". Accordingly, in one embodiment, the process of the present invention comprises the use of a "protein, which is similar to *Lucilia* illustris mitochondria cytochrome oxidase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YOR350C protein is increased or generated, e.g. from *Escherichia coli* or a homolog thereof, preferably linked at least to one transit peptide as mentioned for example in table V.

In another embodiment, in the process of the present invention the activity of a YOR350C protein is increased or generated in a subcellular compartment of the organism or organism cell such as in an organelle like a plastid or mitochondria.

The sequence of YBL082C (Accession number NP_009471) from *Saccharomyces cerevisiae* has been published in Goffeau et al., Science 274 (5287), 546-547, 1996 and Feldmann et al. EMBO J. 13 (24), 5795-5809 (1994), and its activity is being defined as "Dol-P-Man dependent alpha (1-3) mannosyl-transferase". Accordingly, in one embodiment, the process of the present invention comprises the use of a "Dol-P-Man dependent alpha(1-3) mannosyl-transferase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YBL082C protein is increased or generated, e.g. from *Saccharomyces cerevisiae* or a homolog thereof, preferably linked at least to one transit peptide as mentioned for example in table V.

In another embodiment, in the process of the present invention the activity of an YBL082C protein is increased or generated in a subcellular compartment of the organism or organism cell such as in an organelle like a plastid or mitochondria.

The sequence of YDR204W (Accession number NP_010490) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "putative protein" with a role in ubiquinone (Coenzyme Q) biosynthesis, possibly functioning in stabilization of Coq7p; located on the matrix face of the mitochondrial inner membrane; Coq4p". Accordingly, in one embodiment, the process of the present invention comprises the use of said putative protein or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YDR204W protein is increased or generated, e.g. from *Saccharomyces cerevisiae* or a homolog thereof, preferably linked at least to one transit peptide as mentioned for example in table V.

In another embodiment, in the process of the present invention the activity of a YDR204W protein is increased or generated in a subcellular compartment of the organism or organism cell such as in an organelle like a plastid or mitochondria.

The sequence of YKR043C (Accession number NP_012969) from *Saccharomyces cerevisiae* has been published in Goffeau et al., Science 274 (5287), 546-547, 1996 and Dujon et al., Nature 369 (6479), 371-378 (1994) and its activity is beeing defined as a phosphoglycerate mutase like protein. Accordingly, in one embodiment, the process of the present invention comprises the use of said "phosphoglycerate mutase like protein" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YKR043C protein is increased or generated, e.g. from *Saccharomyces cerevisiae* or a homolog thereof, preferably linked at least to one transit peptide as mentioned for example in table V.

In another embodiment, in the process of the present invention the activity of an YKR043C protein is increased or generated in a subcellular compartment of the organism or organism cell such as in an organelle like a plastid or mitochondria.

The sequence of YLR153C (Accession number NP_013254) from *Saccharomyces cerevisiae* has been published in Goffeau et al., Science 274 (5287), 546-547, 1996 and Johnston et al., Nature 387 (6632 Suppl), 87-90 (1997), and its activity is being defined as a "acetyl-CoA synthetase". Accordingly, in one embodiment, the process of the present invention comprises the use of said "acetyl-CoA synthetase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YLR153C protein is increased or generated, e.g. from *Saccharomyces cerevisiae* or a homolog thereof, preferably linked at least to one transit peptide as mentioned for example in table V.

In another embodiment, in the process of the present invention the activity of an YLR153C protein is increased or generated in a subcellular compartment of the organism or organism cell such as in an organelle like a plastid or mitochondria.

The sequence of YLR174W (Accession number NP_013275) from *Saccharomyces cerevisiae* has been published in Goffeau et al., Science 274 (5287), 546-547, 1996 and Johnston et al., Nature 387 (6632 Suppl), 87-90 (1997), and its activity is being defined as "cytosolic NADP-specific isocitrate dehydrogenase", which catalyzes oxidation of isocitrate to alpha-ketoglutarate (Idp2p). Accordingly, in one embodiment, the process of the present invention comprises the use of said "NADP-specific isocitrate dehydrogenase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YLR174W protein is increased or generated, e.g. from *Saccharomyces cerevisiae* or a homolog thereof, preferably linked at least to one transit peptide as mentioned for example in table V.

In another embodiment, in the process of the present invention the activity of an YLR174W protein is increased or generated in a subcellular compartment of the organism or organism cell such as in an organelle like a plastid or mitochondria.

The sequence of YNL241C (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as "glucose-6-phosphate dehydrogenase (Zwf1p)". Accordingly, in one embodiment, the process of the present invention comprises the use of said "glucose-6-phosphate dehydrogenase" or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of an YNL241C protein is increased or generated in a subcellular compartment of the organism or organism cell such as in an organelle like a plastid or mitochondria.

In one embodiment, the homolog of the YDR430C, YMR262W, YOR350C, YBL082C, YDR204W, YKR043C, YLR153C, YLR174W and/or YNL241C, is a homolog having said activity and being derived from Eukaryot. In one embodiment, the homolog of the b0760, b1062, b1277, b2040, b2388, b3443, b4039, b1131, b1264, b2066, b2779, b3213 and/or b3429 is a homolog having said activity and being derived from bacteria. In one embodiment, the homolog of the YDR430C, YMR262W, YOR350C, YBL082C, YDR204W, YKR043C, YLR153C, YLR174W and/or YNL241C is a homolog having said activity and being derived from Fungi. In one embodiment, the homolog of the b0760, b1062, b1277, b2040, b2388, b3443, b4039, b1131, b1264, b2066, b2779, b3213 and/or b3429 is a homolog having said activity and being derived from Proteobacteria. In one embodiment, the homolog of the YDR430C, YMR262W, YOR350C, YBL082C, YDR204W, YKR043C, YLR153C, YLR174W and/or YNL241C is a homolog having said activity and being derived from Ascomycota. In one embodiment, the homolog of the b0760, b1062, b1277, b2040, b2388, b3443, b4039, b1131, b1264, b2066, b2779, b3213 and/or b3429 is a homolog having said activity and being derived from Gammaproteobacteria. In one embodiment, the homolog of the YDR430C, YMR262W, YOR350C, YBL082C, YDR204W, YKR043C, YLR153C, YLR174W and/or YNL241C is a homolog having said activity and being derived from Saccharomycotina. In one embodiment, the homolog of the b0760, b1062, b1277, b2040, b2388, b3443, b4039, b1131, b1264, b2066, b2779, b3213 and/or b3429 is a homolog having said activity and being derived from Enterobacteriales. In one embodiment, the homolog of the YDR430C, YMR262W, YOR350C, YBL082C, YDR204W, YKR043C, YLR153C, YLR174W and/or YNL241C is a homolog having said activity and being derived from *Saccharomycetes*. In one embodiment, the homolog of the b0760, b1062, b1277, b2040, b2388, b3443, b4039, b1131, b1264, b2066, b2779, b3213 and/or b3429 is a homolog having said activity and being derived from Enterobacteriaceae. In one embodiment, the homolog of the YDR430C, YMR262W, YOR350C, YBL082C, YDR204W, YKR043C, YLR153C, YLR174W and/or YNL241C is a homolog having said activity and being derived from *Saccharomycetales*. In one embodiment, the homolog of the b0760, b1062, b1277, b2040, b2388, b3443, b4039, b1131, b1264, b2066, b2779, b3213 and/or b3429 is a homolog having said activity and being derived from *Escherichia*, preferably from *Escherichia coli*. In one embodiment, the homolog of the YDR430C, YMR262W, YOR350C, YBL082C, YDR204W, YKR043C, YLR153C, YLR174W and/or YNL241C is a homolog having said activity and being derived from Saccharomycetaceae. In one embodiment, the homolog of the YDR430C, YMR262W, YOR350C, YBL082C, YDR204W, YKR043C, YLR153C, YLR174W and/or YNL241C is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 2, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 2, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 2, column 3, or which has at least 10% of the original enzymatic activity, preferably 20%, particularly preferably 30%, most particularly preferably 40% in comparison to a protein as shown in table II, application no. 2, column 3 of *Saccharomyces cerevisiae*.

for the disclosure of the paragraphs [0040.0.0.1] to [0047.0.0.1] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 2, column 3 its biochemical or genetical causes and the increased amount of the fine chemical.

for the disclosure of the paragraphs [0049.0.0.1] to [0051.0.0.1] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 2, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modifiy the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.1] to [0058.0.0.1] see paragraphs [0053.0.0.0] to [0058.0.0.0] above.

In case the activity of the *Escherichia coli* protein b0760 or its homologs, e.g. an "ATP-binding component of molybdate transport system" is increased advantageously in an organelle such as a plastid or mitochondria, preferably, in one embodiment an increase of the fine chemical, preferably of threonine between 18% and 33% or more is conferred.

In case the activity of the *Escerichia coli* protein b1062 or its homologs, e.g. a "dihydro-orotase" is increased advantageously in an organelle such as a plastid or mitochondria, preferably, in one embodiment an increase of the fine chemical, preferably of threonine between 23% and 42% or more is conferred.

In case the activity of the *Escherichia coli* protein b1131 or its homologs, e.g. a "adenylosuccinate lyase" is increased advantageously in an organelle such as a plastid or mitochondria, preferably, in one embodiment an increase of the fine chemical, preferably of threonine between 17% and 41% or more is conferred.

In case the activity of the *Escherichia coli* protein b1264 or its homologs, e.g. an "anthranilate synthase component I" is increased advantageously in an organelle such as a plastid or mitochondria, preferably, in one embodiment an increase of the fine chemical, preferably of threonine between 17% and 15% or more is conferred.

In case the activity of the *Escherichia coli* protein b1277 or its homologs, e.g. a "GTP cyclohydrolase II" is increased advantageously in an organelle such as a plastid or mitochondria, preferably, in one embodiment an increase of the fine chemical, preferably of threonine between 17% and 28% or more is conferred.

In case the activity of the *Escherichia coli* protein b2040 or its homologs, e.g. a "TDP-rhamnose synthetase, NAD(P)-binding" is increased advantageously in an organelle such as a plastid or mitochondria, preferably, in one embodiment an increase of the fine chemical, preferably of threonine between 19% and 67% or more is conferred.

In case the activity of the *Escherichia coli* protein b2066 or its homologs, e.g. an "uridine/cytidine kinase" is increased advantageously in an organelle such as a plastid or mitochondria, preferably, in one embodiment an increase of the fine chemical, preferably of threonine between 25% and 93% or more is conferred.

In case the activity of the *Escherichia coli* protein b2388 or its homologs, e.g. a "glucokinase" is increased advantageously in an organelle such as a plastid or mitochondria, preferably, in one embodiment an increase of the fine chemical, preferably of threonine between 24% and 56% or more is conferred.

In case the activity of the *Escherichia coli* protein b2779 or its homologs, e.g. an "enolase" is increased advantageously in an organelle such as a plastid or mitochondria, preferably, in one embodiment an increase of the fine chemical, preferably of threonine between 18% and 33% or more is conferred.

In case the activity of the *Escherichia coli* protein b3213 or its homologs, e.g. a "glutamate synthase (small subunit)" is increased advantageously in an organelle such as a plastid or mitochondria, preferably, in one embodiment an increase of the fine chemical, preferably of threonine between 24% and 77% or more is conferred.

In case the activity of the *Escherichia coli* protein b3429 or its homologs, e.g. a "glycogen synthase" is increased advantageously in an organelle such as a plastid or mitochondria, preferably, in one embodiment an increase of the fine chemical, preferably of threonine between 18% and 55% or more is conferred.

In case the activity of the *Escherichia coli* protein b3443 or its homologs, e.g. a "unknown ORF" is increased advantageously in an organelle such as a plastid or mitochondria, preferably, in one embodiment an increase of the fine chemical, preferably of threonine between 41% and 45% or more is conferred.

In case the activity of the *Escherichia coli* protein b4039 or its homologs, e.g. a "4-hydroxybenzoate synthetase" is increased advantageously in an organelle such as a plastid or mitochondria, preferably, in one embodiment an increase of the fine chemical, preferably of threonine between 18% and 38% or more is conferred.

In case the activity of the *Saccharomyces cerevisiae* protein YDR430C or its homologs, e.g. a "metalloprotease" is increased advantageously in an organelle such as a plastid or mitochondria, preferably, in one embodiment an increase of the fine chemical, preferably of threonine between 67% and 155% or more is conferred.

In case the activity of the *Saccharomyces cerevisiae* protein YMR262W or its homologs, e.g. a "unknown ORF" is increased advantageously in an organelle such as a plastid or mitochondria, preferably, in one embodiment an increase of the fine chemical, preferably of threonine between 26% and 51% or more is conferred.

In case the activity of the *Saccharomyces cerevisiae* protein YOR350c or its homologs, e.g. a "protein similar to *Lucilia illustris* mitochondria cytochrome oxidase" is increased advantageously in an organelle such as a plastid or mitochondria, preferably, in one embodiment an increase of the fine chemical, preferably of threonine between 17% and 70% or more is conferred.

In case the activity of the *Saccharomyces cerevisiae* protein YBL082C or its homologs, e.g. a "Dol-P-Man dependent alpha(1-3) mannosyl-transferase" is increased advantageously in an organelle such as a plastid or mitochondria, preferably, in one embodiment an increase of the fine chemical, preferably of threonine between 16% and 55% or more is conferred.

In case the activity of the *Saccharomyces cerevisiae* protein YDR204W or its homologs, e.g. a "protein which encodes component of the coenzyme Q biosynthetic pathway" is increased advantageously in an organelle such as a plastid or mitochondria, preferably, in one embodiment an increase of the fine chemical, preferably of threonine between 21% and 36% or more is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably, in one embodiment an increase of the fine chemical, preferably of threonine between 25% and 335% or more is conferred.

In case the activity of the *Saccharomyces cerevisiae* protein YLR153C or its homologs, e.g. an "acetyl-CoA synthetase" is increased advantageously in an organelle such as a plastid or mitochondria, preferably, in one embodiment an increase of the fine chemical, preferably of threonine between 23% and 32% or more is conferred.

In case the activity of the *Saccharomyces cerevisiae* protein YLR174W or its homologs, e.g. a "cytosolic NADP-specific isocitrate dehydrogenase" is increased advantageously in an organelle such as a plastid or mitochondria, preferably, in one embodiment an increase of the fine chemical, preferably of threonine between 23% and 31% or more is conferred.

In case the activity of the *Saccharomyces cerevisiae* protein YNL241C or its homologs, e.g. a "glucose-6-phosphate dehydrogenase" is increased advantageously in an organelle such as a plastid or mitochondria, preferably, in one embodiment an increase of the fine chemical, preferably of threonine between 17% and 56% or more is conferred.

In case the activity of the *Escherichia coli* protein b0760 or its homologs, e.g. an "ATP-binding component of molybdate transport system" is increased advantageously in an organelle such as a plastid or mitochondria, preferably an increase of the fine chemical and of proteins containing threonine is conferred.

In case the activity of the *Escherichia coli* protein b1062 or its homologs, e.g. a "dihydro-orotase" is increased advantageously in an organelle such as a plastid or mitochondria, preferably an increase of the fine chemical and of proteins containing threonine is conferred.

In case the activity of the *Escherichia coli* protein b1131 or its homologs, e.g. a "adenylosuccinate lyase" is increased advantageously in an organelle such as a plastid or mitochondria, preferably an increase of the fine chemical and of proteins containing threonine is conferred.

In case the activity of the *Escherichia coli* protein b1264 or its homologs, e.g. an "anthranilate synthase component I" is increased advantageously in an organelle such as a plastid or mitochondria, preferably an increase of the fine chemical and of proteins containing threonine is conferred.

In case the activity of the *Escherichia coli* protein b1277 or its homologs, e.g. a "GTP cyclohydrolase II" is increased advantageously in an organelle such as a plastid or mitochondria, preferably an increase of the fine chemical and of proteins containing threonine is conferred.

In case the activity of the *Escherichia coli* protein b2040 or its homologs, e.g. a "TDP-rhamnose synthetase, NAD(P)-binding" is increased advantageously in an organelle such as a plastid or mitochondria, preferably an increase of the fine chemical and of proteins containing threonine is conferred.

In case the activity of the *Escherichia coli* protein b2066 or its homologs, e.g. an "uridine/cytidine kinase" is increased advantageously in an organelle such as a plastid or mitochondria, preferably an increase of the fine chemical and of proteins containing threonine is conferred.

In case the activity of the *Escherichia coli* protein b2388 or its homologs, e.g. an "glucokinase" is increased advantageously in an organelle such as a plastid or mitochondria, preferably an increase of the fine chemical and of proteins containing threonine is conferred.

In case the activity of the *Escherichia coli* protein b2779 or its homologs, e.g. an "enolase" is increased advantageously in an organelle such as a plastid or mitochondria, preferably an increase of the fine chemical and of proteins containing threonine is conferred.

In case the activity of the *Escherichia coli* protein b3213 or its homologs, e.g. a "glutamate synthase (small subunit)" is increased advantageously in an organelle such as a plastid or mitochondria, preferably an increase of the fine chemical and of proteins containing threonine is conferred.

In case the activity of the *Escherichia coli* protein b3429 or its homologs, e.g. a "glycogen synthase" is increased advantageously in an organelle such as a plastid or mitochondria, preferably an increase of the fine chemical and of proteins containing threonine is conferred.

In case the activity of the *Escherichia coli* protein b3443 or its homologs, e.g. a "unknown ORF" is increased advantageously in an organelle such as a plastid or mitochondria, preferably an increase of the fine chemical and of proteins containing threonine is conferred.

In case the activity of the *Escherichia coli* protein b4039 or its homologs, e.g. a "4-hydroxybenzoate synthetase" is increased advantageously in an organelle such as a plastid or mitochondria, preferably an increase of the fine chemical and of proteins containing threonine is conferred.

In case the activity of the *Saccharomyces cerevisiae* protein YDR430C or its homologs, e.g. a "metalloprotease" is increased advantageously in an organelle such as a plastid or mitochondria, preferably an increase of the fine chemical and of proteins containing threonine is conferred.

In case the activity of the *Saccharomyces cerevisiae* protein YMR262W or its homologs, e.g. a "unknown ORF" is increased advantageously in an organelle such as a plastid or mitochondria, preferably an increase of the fine chemical and of proteins containing threonine is conferred.

In case the activity of the *Saccharomyces cerevisiae* protein YOR350C or its homologs, e.g. a "protein similar to *Lucilia illustris* mitochondria cytochrome oxidase" is increased advantageously in an organelle such as a plastid or mitochondria, preferably an increase of the fine chemical and of proteins containing threonine is conferred.

In case the activity of the *Saccharomyces cerevisiae* protein YBL082C or its homologs, e.g. a "Dol-P-Man dependent alpha(1-3) mannosyl-transferase" is increased advantageously in an organelle such as a plastid or mitochondria, preferably an increase of the fine chemical and of proteins containing threonine is conferred.

In case the activity of the *Saccharomyces cerevisiae* protein YDR204W or its homologs, e.g. a "protein which encodes component of the coenzyme Q biosynthetic pathway" is increased advantageously in an organelle such as a plastid or mitochondria, preferably an increase of the fine chemical and of proteins containing threonine is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably an increase of the fine chemical and of proteins containing threonine is conferred.

In case the activity of the *Saccharomyces cerevisiae* protein YLR153C or its homologs, e.g. an "acetyl-CoA synthetase" is increased advantageously in an organelle such as a plastid or mitochondria, preferably an increase of the fine chemical and of proteins containing threonine is conferred.

In case the activity of the *Saccharomyces cerevisiae* protein YLR174W or its homologs, e.g. a "cytosolic NADP-specific isocitrate dehydrogenase" is increased advantageously in an organelle such as a plastid or mitochondria, preferably an increase of the fine chemical and of proteins containing threonine is conferred.

In case the activity of the *Saccharomyces cerevisiae* protein YNL241C or its homologs, e.g. a "glucose-6-phosphate dehydrogenase" is increased advantageously in an organelle such as a plastid or mitochondria, preferably an increase of the fine chemical and of proteins containing threonine is conferred.

for the disclosure of the paragraphs [0061.0.0.1] and [0062.0.0.1] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 2, column 7 or of the polypeptide as shown in the amino acid sequences as disclosed in table II, application no. 2, columns 5 and 7 or the functional homologues thereof as described herein, or is encoded by the nucleic acid molecule characterized herein or the nucleic acid molecule according to the invention, for example by the nucleic acid molecule as shown in table I, application no. 2, columns 5 and 7 or its herein described functional homologues and has the herein mentioned activity.

For the purposes of the present invention, the terms "L-threonine" and "threonine also encompass the corresponding salts, such as, for example, threonine hydrochloride or threonine sulfate. Preferably the terms threonine is intended to encompass the term L-threonine.

for the disclosure of the paragraphs [0065.0.0.1] and [0066.0.0.1] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 2, columns 5 and 7 or its homologs activity having herein-mentioned threonine increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 2, columns 5 and 7, e.g. a nucleic acid sequence encoding a polypeptide having the activity of a protein as indicated in table II, application no. 2, columns 5 and 7 or its homologs or of a mRNA encoding the polypeptide of the present invention having herein-mentioned threonine increasing activity; and/or c) increasing the specific activity of a protein conferring the increased expression of a protein encoded by the nucleic acid molecule of the invention or of the polypeptide of the present invention having herein-mentioned threonine increasing activity, e.g. of a polypeptide having the activity of a protein as indicated in table II, application no. 2, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned threonine increasing activity, e.g. of a polypeptide having the activity of a protein as indicated in table II, application no. 2, columns 5 and 7 or its homologs activity; and/or e) stimulating activity of a protein conferring the increased expression of a protein encoded by the nucleic acid molecule of the present invention or a polypeptide of the present invention having herein-mentioned threonine increasing activity, e.g. of a polypeptide having the activity of a protein as indicated in table II, application no. 2, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned threonine increasing activity, e.g. of a polypeptide having the activity of a protein as indicated in table II, application no. 2, columns 5 and 7 or its homologs, and/or g) increasing the copy number of a gene conferring the increased expression of a nucleic acid molecule encoding a polypeptide encoded by the nucleic acid molecule of the invention or the polypeptide of the invention having herein-mentioned threonine increasing activity, e.g. of a polypeptide having the activity of a protein as indicated in table II, application no. 2, columns 5 and 7 or its homologs; and/or h) increasing the expression of the endogenous gene encoding the polypeptide of the invention, e.g. a polypeptide having the activity of a protein as indicated in table II, application no. 2, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or (j) selecting of organisms with especially high activity of the proteins of the invention from natural or from mutagenized resources and breeding them into the target organisms, e.g. the elite crops; and/or (k) directing a protein encoded by the nucleic acid molecule of the invention or of the polypeptide of the present invention having herein-mentioned threonine increasing activity, e.g. of a polypeptide having the activity of a protein as indicated in table II, application no. 2, columns 5 and 7 or its homologs activity, to the plastids by the addition of a plastidial targeting sequence; and/or (l) generating the expression of a protein encoded by the nucleic acid molecule of the invention or of the polypeptide of the present invention having herein-mentioned threonine increasing activity, e.g. of a polypeptide having the activity of a protein as indicated in table II, application no. 2, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or (m) generating the expression of a protein encoded by the nucleic acid molecule of the invention or of the polypeptide of the present invention having herein-mentioned threonine increasing activity, e.g. of a polypeptide having the activity of a protein as indicated in table II, application no. 2, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 2, column 3 or its homologs. Preferably the increase of the fine chemical takes place in plastids.

for the disclosure of the paragraphs [0069.0.0.1] to [0079.0.0.1] see paragraphs [0069.0.0.0] to [0079.0.0.0] above.

The activation of an endogenous polypeptide having above-mentioned activity, e.g. having the activity of a protein as shown in table II, application no. 2, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 2, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 2, column 3. The expression of the chimeric transcription factor in a organism, in particular in a plant, leads to a specific expression of the protein as shown in table II, application no. 2, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.1] to [0084.0.0.1] see paragraphs [0081.0.0.0] to [0084.0.0.0] above.

Owing to the introduction of a gene or a plurality of genes conferring the expression of the nucleic acid molecule of the invention or the polypeptide of the invention, for example the nucleic acid construct mentioned below, or encoding the protein as shown in table II, application no. 2, column 3 into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutrional physiology limited) amino acids, like methionine, lysine or threonine alone or in combination in free or bound form.

for the disclosure of this paragraph see paragraph [0086.0.0.0] above.

By influencing the metabolism thus, it is possible to produce, in the process according to the invention, further advantageous compounds. Examples of such compounds are, in addition to threonine for example compounds like amino acids such as methionine or lycine or other desirable compounds.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 2, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound amino acids, in particular threonine.

for the disclosure of the paragraphs [0090.0.0.1] to [0097.0.0.1] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 2, columns 5 and 7 or a derivative thereof, or
b) a genetic regulatory element, for example a promoter, which is functionally linked to the nucleic acid sequence as shown table I, application no. 2, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 2, columns 5 and 7 joined to a nucleic acid sequence encoding a transit peptide, or a targeting nucleic acid sequence which directs the nucleic acid sequences disclosed in table I, application no. 2, columns 5 and 7 to the organelle preferentially the plastids. Alternatively the inventive nucleic acids sequences consist advantageously of the nucleic acid sequences as depicted in the sequence protocol and disclosed in table I, application no. 2, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine. After the activity of the protein as shown in table II, application no. 2, column 3 has been increased or generated in the cytsol or plastids, preferentially in the plastids, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.1] to [0110.0.0.1] see paragraphs [0102.0.0.0] to [0110.0.0.0] above.

In a preferred embodiment, the fine chemical (threonine) is produced in accordance with the invention and, if desired, is isolated. The production of further amino acids such as lysine, methionine etc. and of amino acid mixtures by the process according to the invention is advantageous.

for the disclosure of the paragraphs [0112.0.0.1] to [0115.0.0.1] see paragraphs [0112.0.0.0] to [0115.0.0.0] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 2, columns 5 and 7 or a fragment thereof, which confers an increase in the amount of the fine chemical in an organism or a part thereof;
b) nucleic acid molecule comprising, preferably at least the mature form, of the nucleic acid molecule shown in table I, application no. 2, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybridizes with a nucleic acid molecule of (a) to (c) under stringent hybridisation conditions and conferring an increase in the amount of the fine chemical in an organism or a part thereof;
(f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 2, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 2, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 2, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 2, columns 5 and 7 by one or more nucleotides. In one embodiment, the nucleic acid molecule used in the process of the invention does not consist of the sequence indicated in table IA, application no. 2, columns 5 and 7. In one embodiment, the nucleic acid molecule used in the process of the invention is less than 100%, 99.999%, 99.99%, 99.9% or 99% identical to a sequence indicated in table IA, application no. 2, columns 5 and 7. In another embodiment, the nucleic acid molecule does not encode a polypeptide of a sequence indicated in table IIA, application no. 2, columns 5 and 7.

In one embodiment, the nucleic acid molecule used in the process of the invention distinguishes over the sequence indicated in table IB, application no. 2, columns 5 and 7, by one or more nucleotides. In one embodiment, the nucleic acid molecule used in the process of the invention does not consist of the sequence indicated in table IB, application no. 2, columns 5 and 7. In one embodiment, the nucleic acid molecule used in the process of the invention is less than 100%, 99.999%, 99.99%, 99.9% or 99% identical to a sequence indicated in table IB, application no. 2, columns 5 and 7. In another embodiment, the nucleic acid molecule does not encode a polypeptide of a sequence indicated in table IIB, application no. 2, columns 5 and 7.

In one embodiment, the nucleic acid molecule used in the process distinguishes over the sequence shown in table I, application no. 2, columns 5 and 7 by one or more nucleotides or does not consist of the sequence shown in table I, application no. 2, columns 5 and 7. In one embodiment, the nucleic acid molecule of the present invention is less than 100%, 99.999%, 99.99%, 99.9% or 99% identical to the sequence shown in table I, application no. 2, columns 5 and 7. In another embodiment, the nucleic acid molecule does not encode a polypeptide of the sequence shown in table II, application no. 2, columns 5 and 7.

for the disclosure of the paragraphs [0118.0.0.1] to [0120.0.0.1] see paragraphs [0118.0.0.0] to [0120.0.0.0] above.

Nucleic acid molecules with the sequence shown in table I, application no. 2, columns 5 and 7, nucleic acid molecules which are derived from the amino acid sequences shown in table II, application no. 2, columns 5 and 7 or from polypeptides comprising the consensus sequence shown in table IV, application no. 2, column 7, or their derivatives or homologues encoding polypeptides with the enzymatic or biological activity of a protein as shown in table II, application no. 2, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 2, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 2, column 3 and conferring the fine chemical increase by expression either in the cytsol or in an organelle such as a plastid or mitochondria or both, preferably in plastids.

for the disclosure of the paragraphs [0126.0.0.1] to [0133.0.0.1] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 2, columns 5 and 7 or the functional homologues thereof as described herein, preferably conferring above-mentioned activity, i.e. conferring the fine chemical increase after increasing its activity, e.g. after increasing the activity of a protein as shown in table II, column 3 by for example expression either in the cytsol or in an organelle such as a plastid or mitochondria or both, preferably in plastids.

for the disclosure of the paragraphs [0135.0.0.1] to [0140.0.0.1] see paragraphs [0135.0.0.0] to [0140.0.0.0] above.

Synthetic oligonucleotide primers for the amplification, e.g. as shown in table III, application no. 2, column 7, by means of polymerase chain reaction can be generated on the basis of a sequence shown herein, for example the sequence shown in table I, application no. 2, columns 5 and 7 or the sequences derived from table II, application no. 2, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 2, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 2, column 3 or further functional homologs of the polypeptide of the invention from other organisms.

for the disclosure of the paragraphs [0144.0.0.1] to [0151.0.0.1] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 2, columns 5 and 7, preferably shown in table IB, application no. 2, columns 5 and 7 under relaxed hybridization conditions and which code on expression for peptides having the threonine increasing activity.

for the disclosure of the paragraphs [0153.0.0.1] to [0159.0.0.1] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 2, columns 5 and 7, preferably shown in table IB, application no. 2, columns 5 and 7 is one which is sufficiently complementary to one of the nucleotide sequences shown in table I, application no. 2, columns 5 and 7, preferably shown in table IB, application no. 2, columns 5 and 7 such that it can hybridize to one of the nucleotide sequences shown in table I, application no. 2, columns 5 and 7, preferably shown in table IB, application no. 2, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 2, columns 5 and 7, preferably shown in table IB, application no. 2, columns 5 and 7, or a portion thereof and preferably has above mentioned activity, in particular having a fine chemical increasing activity after increasing the activity or an activity of a gene product as shown in table II, application no. 2, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 2, columns 5 and 7, preferably shown in table IB, application no. 2, columns 5 and 7, or a portion thereof and encodes a protein having above-mentioned activity, e.g. conferring of a threonine increase by for example expression either in the cytsol or in an organelle such as a plastid or mitochondria or both, preferably in plastids, and optionally, the activity of a protein as shown in table II, application no. 2, column 3.

Moreover, the nucleic acid molecule of the invention can comprise only a portion of the coding region of one of the sequences shown in table I, application no. 2, columns 5 and 7, preferably shown in table IB, application no. 2, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 2, columns 5 and 7, an anti-sense sequence of one of the sequences, e.g., set forth in table I, application no. 2, columns 5 and 7, preferably shown in table IB, application no. 2, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 2, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 2, columns 5 and 7 such that the protein or portion thereof maintains the ability to participate in the fine chemical production, in particular a threonine increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 2, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 2, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.1] and [0169.0.0.1] see paragraphs [0168.0.0.0] to [0169.0.0.0] above.

The invention further relates to nucleic acid molecules that differ from one of the nucleotide sequences shown in table I, application no. 2, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 2, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 2, columns 5 and 7 or the functional homologues. In a still further embodiment, the nucleic acid molecule of the invention encodes a full length protein which is substantially homologous to an amino acid sequence shown in table II, application no. 2, columns 5 and 7 or the functional homologues. However, in a preferred embodiment, the nucleic acid molecule of the present invention does not consist of the sequence shown in table I, application no. 2, columns 5 and 7, preferably as indicated in table IA, application no. 2, columns 5 and 7. Preferably the nucleic acid molecule of the invention is a functional homologue or identical to a nucleic acid molecule indicated in table IB, application no. 2, columns 5 and 7.

for the disclosure of the paragraphs [0171.0.0.1] to [0173.0.0.1] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 2, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 2, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having abovementioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 2, columns 5 and 7.

for the disclosure of the paragraphs [0179.0.0.1] and [0180.0.0.1] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 2, columns 5 and 7, preferably shown in table IIA, application no. 2, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 2, columns 5 and 7, preferably shown in table IIA, application no. 2, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 2, columns 5 and 7, preferably shown in table IIA, application no. 2, columns 5 and 7, more preferably at least about 70% identical to one of the sequences shown in table II, application no. 2, columns 5 and 7, preferably shown in table IIA, application no. 2, columns 5 and 7, even preferably at least about 80%, 90%, 95% homologous to the sequence shown in table II, application no. 2, columns 5 and 7, and most preferably at least about 96%, 97%, 98%, or 99% identical to the sequence shown in table II, application no. 2, columns 5 and 7, preferably shown in table IIA, application no. 2, columns 5 and 7.

for the disclosure of the paragraphs [0182.0.0.1] to [0188.0.0.1] see paragraphs [0182.0.0.0] to [0188.0.0.0] above.

Functional equivalents derived from one of the polypeptides as shown in table II, application no. 2, columns 5 and 7, preferably shown in table IIB, application no. 2, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 2, columns 5 and 7, preferably shown in table IIB, application no. 2, columns 5 and 7 resp., according to the invention and are distinguished by essentially the same properties as the polypeptide as shown in table II, application no. 2, columns 5 and 7, preferably shown in table IIB, application no. 2, columns 5 and 7.

Functional equivalents derived from the nucleic acid sequence as shown in table I, application no. 2, columns 5 and 7, preferably shown in table IB, application no. 2, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 2, columns 5 and 7, preferably shown in table IIB, application no. 2, columns 5 and 7 resp., according to the invention and encode polypeptides having essentially the same properties as the polypeptide as shown in table II, application no. 2, columns 5 and 7, preferably shown in table IIB, application no. 2, columns 5 and 7.

for the disclosure of this paragraph see paragraph [0191.0.0.0] above.

A nucleic acid molecule encoding an homologous to a protein sequence of table II, application no. 2, columns 5 and 7, preferably shown in table IIB, application no. 2, columns 5 and 7 resp., can be created by introducing one or more nucleotide substitutions, additions or deletions into a nucleotide sequence of the nucleic acid molecule of the present invention, in particular of table I, application no. 2, columns 5 and 7, preferably shown in table IB, application no. 2, columns 5 and 7 resp., such that one or more amino acid substitutions, additions or deletions are introduced into the encoded protein. Mutations can be introduced into the encoding sequences of table I, application no. 2, columns 5 and 7, preferably shown in table IB, application no. 2, columns 5 and 7 resp., by standard techniques, such as site-directed mutagenesis and PCR-mediated mutagenesis.

for the disclosure of the paragraphs [0193.0.0.1] to [0196.0.0.1] see paragraphs [0193.0.0.0] to [0196.0.0.0] above.

Homologues of the nucleic acid sequences used, with the sequence shown in table I, application no. 2, columns 5 and 7, preferably shown in table IB, application no. 2, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 2, columns 5 and 7, preferably shown in table IB, application no. 2, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 2, columns 5 and 7, preferably shown in table IB, application no. 2, columns 5 and 7. It is preferred that the nucleic acid molecule comprises as little as possible other nucleotides not shown in any one of table I, application no. 2, columns 5 and 7, preferably shown in table IB, application no. 2, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 2, columns 5 and 7, preferably shown in table IB, application no. 2, columns 5 and 7.

Also preferred is that the nucleic acid molecule used in the process of the invention encodes a polypeptide comprising the sequence shown in table II, application no. 2, columns 5 and 7, preferably shown in table IIB, application no. 2, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 2, columns 5 and 7, preferably shown in table IIB, application no. 2, columns 5 and 7.

In one embodiment, the nucleic acid molecule of the invention or used in the process encodes a polypeptide comprising the sequence shown in table II, application no. 2, columns 5 and 7, preferably shown in table IIB, application no. 2, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 2, columns 5 and 7, preferably shown in table IB, application no. 2, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 2, columns 5 and 7 expressed under identical conditions.

Homologues of table I, application no. 2, columns 5 and 7 or of the derived sequences of table II, application no. 2, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.1] to [0215.0.0.1] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 2, columns 5 and 7; preferably shown in Table IIB application no. 2, columns 5 and 7, or a fragment thereof conferring an increase in the amount of the fine chemical in an organism or a part thereof b) nucleic acid molecule comprising, preferably at least the mature form, of the nucleic acid molecule shown in table I, application no. 2, columns 5 and 7 preferably shown in Table IB application no. 2, columns 5 and 7, or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 2, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 2, columns 7 and conferring an increase in the amount of the fine chemical in an organism or a part thereof;

k) nucleic acid molecule encoding the amino acid sequence of a polypeptide encoding a domain of the polypeptide shown in table II, application no. 2, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 2, columns 5 and 7 or a nucleic acid molecule encoding, preferably at least the mature form of, the polypeptide shown in table II, application no. 2, columns 5 and 7, and conferring an increase in the amount of the fine chemical in an organism or a part thereof; or which encompasses a sequence which is complementary thereto; whereby, preferably, the nucleic acid molecule according to (a) to (l) distinguishes over the sequence depicted in table IA and/or IB, application no. 2, columns 5 and 7 by one or more nucleotides. In one embodiment, the nucleic acid molecule of the invention does not consist of the sequence shown in table IA and/or IB, application no. 2, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 2, columns 5 and 7. In a further embodiment the nucleic acid molecule does not encode the polypeptide sequence shown in table IIA and/or IIB, application no. 2, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 2, columns 5 and 7 does not encode a protein of the sequence shown in table IIA and/or IIB, application no. 2, columns 5 and 7. Accordingly, in one embodiment, the protein encoded by a sequence of a nucleic acid according to (a) to (l) does not consist of the sequence shown in table IA and/or IB, application no. 2, columns 5 and 7. In a further embodiment, the protein of the present invention is at least 30% identical to protein sequence depicted in table IIA and/or IIB, application no. 2, columns 5 and 7 and less than 100%, preferably less than 99.999%, 99.99% or 99.9%, more preferably less than 99%, 985, 97%, 96% or 95% identical to the sequence shown in table IIA and/or IIB, application no. 2, columns 5 and 7.

for the disclosure of the paragraphs [0217.0.0.1] to [0226.0.0.1] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 2, columns 5 and 7 can be cloned 3'prime to the transitpeptide encoding sequence, leading to a functional pre-protein, which is directed to the plastids and which means that the mature protein fulfills its biological activity.

for the disclosure of the paragraphs [0228.0.0.1] to [0239.0.0.1] see paragraphs [0228.0.0.0] to [0239.0.0.0] above.

In addition to the sequence mentioned in table I, application no. 2, columns 5 and 7 or its derivatives, it is advantageous additionally to express and/or mutate further genes in the organisms. Especially advantageously, additionally at least one further gene of the amino acid biosynthetic pathway such as for L-lysine, L-threonine and/or L-methionine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the nucleic acids sequences of the invention containing the sequences shown in table I, application no. 2, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.0.1] to [0264.0.0.1] see paragraphs [0241.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 2, columns 5 and 7 and described herein to achieve an expression in one of said compartments or extracellular.

for the disclosure of the paragraphs [0266.0.0.1] to [0287.0.0.1] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 2, columns 5 and 7 or their homologs is functionally linked to a plastidial targeting sequence. A further preferred embodiment of the invention relates to a vector in which a nucleic acid sequence encoding one of the polypeptides shown in table II, application no. 2, columns 5 and 7 or their homologs is functionally linked to a regulatory sequences which permit the expression in plastids.

for the disclosure of the paragraphs [0289.0.0.1] to [0296.0.0.1] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0760, anti-b1062, anti-b1277, anti-b2040, anti-b2388, anti-b3443, anti-b4039, anti-b1131, anti-b1264, anti-b2066, anti-b2779, anti-b3213, anti-b3429, anti-YDR430C, anti-YMR262W, anti-YOR350C, anti-YBL082C, anti-YDR204W, anti-YKR043C, anti-YLR153C, anti-YLR174W and/or anti-YNL241C protein antibody or an antibody against polypeptides as shown in table II, application no. 2, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 2, columns 5 and 7 or as coded by the nucleic acid molecule shown in table I, application no. 2, columns 5 and 7 or functional homologues thereof.

In one advantageous embodiment, in the method of the present invention the activity of a polypeptide is increased comprising or consisting of the consensus sequence shown in table IV, application no. 2, columns 7 and in one another embodiment, the present invention relates to a polypeptide comprising or consisting of the consensus sequence shown in table IV, application no. 2, columns 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.1] to [0304.0.0.1] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 2, columns 5 and 7 by one or more amino acids. In one embodiment, polypeptide distinguishes form the sequence shown in table IIA and/or IIB, application no. 2, columns 5 and 7 by more than 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from the sequence shown in table II, application no. 2, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table II, application no. 2, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 2, columns 5 and 7 by one or more amino acids. In another embodiment, said polypeptide of the invention does not consist of the sequence shown in table IIA and/or IIB, application no. 2, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 2, columns 5 and 7.

In one embodiment, the present invention relates to a polypeptide having the activity of the protein as shown in table IIA and/or IIB, application no. 2, column 3, which distinguishes over the sequence depicted in table IIA and/or IIB, application no. 2, columns 5 and 7 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.1] to [0311.0.0.1] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table IIA and/or IIB, application no. 2, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 2, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 2, columns 5 and 7 or which is homologous thereto, as defined above.

Accordingly the polypeptide of the present invention can vary from the sequences shown in table IIA and/or IIB, application no. 2, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 2, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 2, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 2, column 3. Differences shall mean at least one amino acid different from the sequences as shown in table II, application no. 2, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 2, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 2, column 3. The nucleic acid molecules and polypeptide molecules of the invention are expressed such that the yield, production, and/or efficiency of production of a desired compound is improved.

for the disclosure of the paragraphs [0320.0.0.1] to [0322.0.0.1] see paragraphs [0320.0.0.0] to [0322.0.0.0] above.

In one embodiment, a protein (=polypeptide) as shown in table II, application no. 2, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 2, column 3, e.g., a protein which does not confer the activity described herein and which is derived from the same or a different organism.

for the disclosure of the paragraphs [0324.0.0.1] to [0329.0.0.1] see paragraphs [0324.0.0.0] to [0329.0.0.0] above.

In an especially preferred embodiment, the polypeptide according to the invention furthermore also does not have the sequences of those proteins which are encoded by the sequences shown in table II, application no. 2, columns 5 and 7.

for the disclosure of the paragraphs [0331.0.0.1] to [0346.0.0.1] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 2, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 2, column 3 or a protein as shown in table II, application no. 2, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 2, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.1] to [0369.0.0.1] see paragraphs [0350.0.0.0] to [0369.0.0.0] above.

The fermentation broths obtained in this way, containing in particular L-methionine, L-threonine and/or L-lysine preferably L-threonine, normally have a dry matter content of from 7.5 to 25% by weight. The fermentation broth can be processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

for the disclosure of the paragraphs [0371.0.0.1] to [0376.0.0.1], [0376.1.0.1] and [0377.0.0.1] see paragraphs [0371.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 2, columns 5 and 7, preferably in table IB, application no. 2, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.1] to [0383.0.0.1] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 2, column 3, e.g. comparing near identical organisms with low and high activity of the proteins as shown in table II, application no. 2, column 3.

for the disclosure of the paragraphs [0385.0.0.1] to [0435.0.0.1] see paragraphs [0385.0.0.0] to [0435.0.0.0] above.

Threonine production in *Chlamydomonas reinhardtii*

The amino acid production can be analysed as mentioned above. The proteins and nucleic acids can be analysed as mentioned below.

for the disclosure of the paragraphs [0437.0.0.1] to [0497.0.0.1] see paragraphs [0437.0.0.0] to [0497.0.0.0] above.

The results of the different plant analyses can be seen from the table, which follows:

TABLE VI

| ORF | Metabolite | Method | Min | Max |
|---|---|---|---|---|
| YBL082C | Threonine | GC | 1.16 | 1.55 |
| YDR204W | Threonine | GC | 1.21 | 1.36 |
| YKR043C | Threonine | GC | 1.25 | 4.35 |
| YLR153C | Threonine | GC | 1.23 | 1.32 |
| YLR174W | Threonine | GC | 1.23 | 1.31 |
| YNL241C | Threonine | GC | 1.17 | 1.56 |
| b2066 | Threonine | GC | 1.25 | 1.93 |
| b2779 | Threonine | GC | 1.18 | 1.33 |
| b3429 | Threonine | GC | 1.18 | 1.55 |
| b1131 | Threonine | GC | 1.17 | 1.41 |
| B1264 | Threonine | GC | 1.17 | 1.55 |
| B3213 | Threonine | GC | 1.24 | 1.77 |
| B0760 | Threonine | GC | 1.18 | 1.33 |
| B1062 | Threonine | GC | 1.23 | 1.42 |
| B1277 | Threonine | GC | 1.17 | 1.28 |
| B2040 | Threonine | GC | 1.19 | 1.67 |
| B2388 | Threonine | GC | 1.24 | 1.56 |
| B3443 | Threonine | LC | 1.41 | 1.45 |
| B4039 | Threonine | GC | 1.18 | 1.38 |

TABLE VI-continued

| ORF | Metabolite | Method | Min | Max |
|---|---|---|---|---|
| YDR430C | Threonine | LC | 1.67 | 2.55 |
| YMR262W | Threonine | LC | 1.26 | 1.51 |
| YOR350C | Threonine | GC | 1.17 | 1.70 | for the disclosure of the paragraphs [0499.0.0.1] and [0500.0.0.1] see paragraphs [0499.0.0.0] and [0500.0.0.0] above.

Example 15a

Engineering Ryegrass Plants by Over-expressing YBL082C from *Saccharomyces cerevisiae* or Homologs of YBL082C from Other Organisms for the disclosure of the paragraphs [0502.0.0.1] to [0508.0.0.1] see paragraphs [0502.0.0.0] to [0508.0.0.0] above.

Example 15b

Engineering Soybean Plants by Over-expressing YBL082C from *Saccharomyces cerevisiae* or Homologs of YBL082C from Other Organisms for the disclosure of the paragraphs [0510.0.0.1] to [0513.0.0.1] see paragraphs [0510.0.0.0] to [0513.0.0.0] above.

Example 15c

Engineering Corn Plants by Over-expressing YBL082C from *Saccharomyces cerevisiae* or Homologs of YBL082C from Other Organisms for the disclosure of the paragraphs [0515.0.0.1] to [0540.0.0.1] see paragraphs [0515.0.0.0] to [0540.0.0.0] above.

Example 15d

Engineering Wheat Plants by Over-expressing YBL082C from *Saccharomyces cerevisiae* or Homologs of YBL082C from Other Organisms for the disclosure of the paragraphs [0542.0.0.1] to [0544.0.0.1] see paragraphs [0542.0.0.0] to [0544.0.0.0] above.

Example 15e

Engineering Rapeseed/Canola Plants by Over-expressing YBL082C from *Saccharomyces cerevisiae* or Homologs of YBL082C from Other Organisms for the disclosure of the paragraphs [0546.0.0.1] to [0549.0.0.1] see paragraphs [0544.0.0.0] to [0549.0.0.0] above.

Example 15f

Engineering Alfalfa Plants by Over-expressing YBL082C from *Saccharomyces cerevisiae* or Homologs of YBL082C from Other Organisms for the disclosure of the paragraphs [0551.0.0.1] to [0554.0.0.1] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII

TABLE VII

| ORF_NAME | Metabolite | MIN | MAX |
|---|---|---|---|
| b2066 | Threonine | 1.55 | 2.33 |
| b3429 | Threonine | 1.43 | 1.82 |
| YKR043C | Threonine | 1.44 | 10.55 |

Table VII shows the increase in methionine in genetically modified corn plants expressing the *Escherichia coli* nucleic acid sequences b2066 and b3429 or the *Saccharomyces cerevisiae* nucleic acid sequence YKR043C.

In one embodiment, in case the activity of the *Escherichia coli* protein b2066 or its homologs, e.g. a "uridine/cytidine kinase", is increased in corn plants, preferably, an increase of the fine chemical threonine between 55% and 133% or more is conferred.

In one embodiment, in case the activity of the *Escherichia coli* protein b3429 or its homologs, e.g. a "glycogen synthase", is increased in corn plants, preferably, an increase of the fine chemical threonine between 43% and 82% or more is conferred.

In one embodiment, in case the activity of the *Saccharomyces cerevisiae* protein YKR043C or its homologs, e.g. a "unknown ORF", is increased in corn plants, preferably, an increase of the fine chemicals threonine between 44% and 955% or more is conferred.

for the disclosure of this paragraph see [0554.2.0.0] above.
for the disclosure of this paragraph see [0555.0.0.0] above.
for the disclosure of the paragraphs [0001.0.0.2] to [0007.0.0.2] see paragraphs [0001.0.0.0] to [0007.0.0.0] above.
for the disclosure of the paragraphs [0007.1.0.2] and [0008.0.0.2] see paragraphs [0007.1.0.0] and [0008.0.0.0] above.

As described above, the essential amino acids are necessary for humans and many mammals, for example for livestock. Tryptophane (L-tryptophane) is one of the most reactive amino acids. At pH 4.0-6.0 tryptophane's amino group reacts with aldehydes producing Schiff-bases. On the other hand if the amino group is blocked by acetylation, tryptophane reacts with aldehydes yielding carboline derivatives (carboline 1,2,3,4-tetrahydro-carboline-3-carboxylic acid). Tryptophane plays a unique role in defense against infection because of its relative scarcity compared to other amino acids. During infection, the body induces tryptophane-catabolizing enzymes, which increase tryptophane's scarcity in an attempt to starve the infecting organisms [R. R. Brown, Y. Ozaki, S. P. Datta, et al., Implications of interferon-induced tryptophane catabolism in cancer, autoimmune diseases and AIDS. In: Kynurenine and Serotonin Pathways, R. Schwarcz, et al., (Eds.), Plenum Press, New York, 1991]. In most proteins, tryptophane is the least abundant essential amino acid, comprising approximately 1% of plant proteins and 1.5% of animal proteins. Although the minimum daily requirement for tryptophane is 160 mg for women and 250 mg for men, 500-700 mg are recommended to ensure high-quality protein intake. Actual tryptophane utilization is substantially higher. Men use approximately 3.5 grams of tryptophane to make one days's worth of protein [J. C. Peters, Tryptophane Nutrition and Metabolism: an Overview. In: Kynurenine and Serotonin Pathways, R. Schwarcz, et al., (Eds.), Plenum Press, New York, 1991]. The balance is obtained by hepatic recycling of tryptophane from used (catabolized) proteins.

Dietary tryptophane is well absorbed intestinally. About 10% of the tryptophane circulating in the bloodstream is free, and 90% is bound to the protein albumin. The tryptophane binding site on albumin also has affinity for free fatty acids (FFAs), so tryptophane is displaced when FFAs rise, as when fasting.

Although tryptophane is not usually the limiting amino acid in protein synthesis, tryptophane may become insufficient for the normal functioning of other tryptophane-dependent pathways. Numerous lines of research point to tryptophane's central role in regulation of feeding and other behaviors. Tryptophane is not only typically the least abundant amino acid in the liver's free amino acid pool, but liver tryptophane-tRNA levels fall faster during food deprivation than other indispensable amino acids [Q. R. Rogers, The nutritional and metabolic effects of amino acid imbalances. In: Protein Metabolism and Nutrition, D. J. A. Cole (Ed.), Butterworths, London, 1976]. Under fasting conditions, and possibly in wasting syndromes, tryptophane may become the rate-limiting amino acid for protein synthesis [Peters, 1991].

for the disclosure of the paragraphs [0010.0.0.2] and [0011.0.0.2] see paragraphs [0010.0.0.0] and [0011.0.0.0] above.

It is an object of the present invention to develop an inexpensive process for the synthesis of tryptophane, preferably L-tryptophane. Tryptophane is together with methionine, lysine and threonine (depending on the organism) one of the amino acids, which are most frequently limiting.

for the disclosure of this paragraph see [0013.0.0.0] above.

Accordingly, in a first embodiment, the invention relates to a process for the production of a fine chemical, whereby the fine chemical is tryptophane, preferably L-tryptophane. Accordingly, in the present invention, the term "the fine chemical" as used herein relates to "tryptophane". Further, the term "the fine chemicals" as used herein also relates to fine chemicals comprising tryptophane.

In one embodiment, the term "the fine chemical" means tryptophane, preferably L-tryptophane. Throughout the specification the term "the fine chemical" means tryptophane, preferably L-tryptophane, its salts, ester or amids in free form or bound to proteins. In a preferred embodiment, the term "the fine chemical" means tryptophane, preferably L-tryptophane in free form or its salts or bound to proteins.

Accordingly, the present invention relates to a process for the production of tryptophane, which comprises
(a) increasing or generating the activity of a protein as shown in table II, application no. 3, column 3 encoded by the nucleic acid sequences as shown in table I, application no. 3, column 5, in an organelle of a microorganism or plant, or (b) increasing or generating the activity of a protein as shown in table II, application no. 3, column 3 encoded by the nucleic acid sequences as shown in table I, application no. 3, column 5 in the plastid of a microorganism or plant, or in one or more parts thereof; and
(c) growing the organism under conditions which permit the production of the fine chemical, thus, tryptophane or fine chemicals comprising tryptophane, in said organism or in the culture medium surrounding the organism.

In another embodiment the present invention is related to a process for the production of tryptophane, which comprises
(a) increasing or generating the activity of a protein as shown in table II, application no. 3, column 3 encoded by the nucleic acid sequences as shown in table I, application no. 3, column 5, in an organelle of a non-human organism, or
(b) increasing or generating the activity of a protein as shown in table II, application no. 3, column 3 encoded by the nucleic acid sequences as shown in table I, application no. 3, column 5, which are joined to a nucleic acid sequence encoding a transit peptide in a non-human organism, or in one or more parts thereof; or
(c) increasing or generating the activity of a protein as shown in table II, application no. 3, column 3 encoded by the nucleic acid sequences as shown in table I, application no. 3, column 5, which are joined to a nucleic acid sequence encoding chloroplast localization sequence, in a non-human organism, or in one or more parts thereof, and
(d) growing the organism under conditions which permit the production of tryptophane in said organism.

In another embodiment, the present invention relates to a process for the production of tryptophane, which comprises
(a) increasing or generating the activity of a protein as shown in table II, application no. 3, column 3 encoded by the nucleic acid sequences as shown in table I, application no. 3, column 5, in an organelle of a microorganism or plant through the transformation of the organelle, or
(b) increasing or generating the activity of a protein as shown in table II, application no. 3, column 3 encoded by the nucleic acid sequences as shown in table I, application no. 3, column 5 in the plastid of a microorganism or plant, or in one or more parts thereof through the transformation of the plastids; and
(c) growing the organism under conditions which permit the production of the fine chemical, thus, tryptophane or fine chemicals comprising tryptophane, in said organism or in the culture medium surrounding the organism.

Advantageously the activity of the protein as shown in table II, application no. 3, column 3 encoded by the nucleic acid sequences as shown in table I, application no. 3, column 5 is increased or generated in the abovementioned process in the plastid of a microorganism or plant.

for the disclosure of the paragraphs [0019.0.0.2] to [0024.0.0.2] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 3, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ sub-unit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 3, column 3 and its homologs as disclosed in table I, application no. 3, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 3, column 3 and its homologs as disclosed in table I, application no. 3, columns 5 and 7.

for the disclosure of the paragraphs [0027.0.0.2] to [0029.0.0.2] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 3, columns 5 and 7. The person skilled in the art is able to join said sequences in a functional manner. Advantageously the transit peptide part is cleaved off from the protein part shown in table II, application no. 3, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 3, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 3, columns 5 and 7. In case of the amino acid sequence QIA CSS the three amino acids in front of the start methionine are stemming from the LIC (=ligation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 3, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 3, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 3, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.2] and [0030.3.0.2] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 3, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 3, columns 5 and 7 or a sequence encoding a protein, as depicted in table II, application no. 3, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 3, columns 5 and 7 or a sequence encoding a protein, as depicted in table II, application no. 3, columns 5 and 7 in such a manner that the viroid sequence transports a sequence transcribed from a sequence as depicted in table I, application no. 3 columns 5 and 7 or a sequence encoding a protein as depicted in table II, application no. 3 columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 3, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 3, columns 5 and 7.

In a preferred embodiment of the invention the nucleic acid sequences as shown in table I, application no. 3, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 3, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.2] and [0032.0.0.2] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 3, column 3. Preferably the modification of the activity of a protein as shown in table II, application no. 3, column 3 or their combination can be achieved by joining the protein to a transit peptide.

Surprisingly it was found, that the transgenic expression of the Saccaromyces cerevisiae protein as shown in table II, application no. 3, column 3 in plastids of a plant such as Arabidopsis thaliana for example through the linkage to at least one targeting sequence for example as mentioned in table V conferred an increase in the fine chemical content of the transformed plants.

for the disclosure of this paragraph see paragraph [0035.0.0.0] above.

The sequence of b1223 (Accession number NP_415741) from Escherichia coli has been published in Blattner et al., Science 277 (5331), 1453-1474 (1997), and its activity is being defined as "nitrite extrusion protein". Accordingly, in one embodiment, the process of the present invention comprises the use of a "nitrite extrusion protein" or its homolog, e.g. as shown herein, for the production of the fine chemical, meaning of tryptophane, in particular for increasing the amount of tryptophane in free or bound form in an organism or a part thereof, as mentioned. In one embodiment, in the process of the present invention the activity of a b1223 protein is increased or generated, e.g. from Escherichia coli or a homolog thereof, preferably linked at least to one transit peptide as mentioned for example in table V.

In another embodiment, in the process of the present invention the activity of a b1223 protein is increased or generated in a subcellular compartment of the organism or organism cell such as in an organelle like a plastid or mitochondria.

The sequence of b1704 (Accession number NP_416219) from Escherichia coli has been published in Blattner et al., Science 277 (5331), 1453-1474 (1997), and its activity is being defined as a "3-deoxy-D-arabinoheptulosonate-7-phosphate synthase (DAHP synthetase, tryptophan repressible)". Accordingly, in one embodiment, the process of the present invention comprises the use of a "3-deoxy-D-arabinoheptulosonate-7-phosphate synthase" or its homolog, e.g. as shown herein, for the production of the fine chemical, meaning of tryptophane, in particular for increasing the amount of tryptophane phane in free or bound form in an organism or a part thereof, as mentioned. In one embodiment, in the process of the present invention the activity of a b1704 protein is increased or generated, e.g. from Escherichia coli or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b2601 (Accession number NP_417092) from Escherichia coli has been published in Blattner et al., Science 277 (5331), 1453-1474 (1997), and its activity is being defined as a "3-deoxy-D-arabinoheptulosonate-7-phosphate synthase (DAHP synthetase, tyrosine-repressible)". Accordingly, in one embodiment, the process of the present invention comprises the use of a "3-deoxy-D-arabinoheptulosonate-7-phosphate synthase" or its homolog, e.g. as shown herein, for the production of the fine chemical, meaning of tryptophane, in particular for increasing the amount of tryptophane in free or bound form in an organism or a part thereof, as mentioned. In one embodiment, in the process of the present invention the activity of a b2601 protein is increased or generated, e.g. from Escherichia coli or a homolog thereof, preferably linked at least to one transit peptide as mentioned for example in table V.

In another embodiment, in the process of the present invention the activity of a b2601 protein is increased or generated in a subcellular compartment of the organism or organism cell such as in an organelle like a plastid or mitochondria.

The sequence of b2965 (Accession number NP_417440) from Escherichia coli has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase isozyme" or its homolog, e.g. as shown herein, for the production of the fine chemical, meaning of tryptophane, in particular for increasing the amount of tryptophane in free or bound form in an organism or a part thereof, as mentioned. In one embodiment, in the process of the present invention the activity of a b2965 protein is increased or generated, e.g. from Escherichia coli or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b3390 (Accession number YP_026215) from Escherichia coli has been published in Blattner et al., Science 277 (5331), 1453-1474 (1997), and its activity is being defined as a "shikimate kinase I". Accordingly, in one embodiment, the process of the present invention comprises the use of a "shikimate kinase I" or its homolog, e.g. as shown herein, for the production of the fine chemical, meaning of tryptophane, in particular for increasing the amount of tryptophane in free or bound form in an organism or a part thereof, as mentioned. In one embodiment, in the process of the present invention the activity of a b3390 protein is increased or generated, e.g. from Escherichia coli or a homolog thereof, preferably linked at least to one transit peptide as mentioned for example in table V.

In another embodiment, in the process of the present invention the activity of a b3390 protein is increased or generated in a subcellular compartment of the organism or organism cell such as in an organelle like a plastid or mitochondria.

The sequence of YOR353C (Accession number NP_014998) from Saccharomyces cerevisiae has been published in Goffeau et al., Science 274 (5287), 546-547, 1996 and Dujon et al., Nature 387 (6632 Suppl), 98-102 (1997), and its activity is being defined as a "protein required for cell morphogenesis and cell separation after mitosis; Sog2p". Accordingly, in one embodiment, the process of the present invention comprises the use of a "protein required for cell morphogenesis and cell separation after mitosis; Sog2p" or its homolog, e.g. as shown herein, for the production of the fine chemical, meaning of tryptophane in free or bound form, in particular for increasing the amount of tryptophane in free or bound form in an organism or a part thereof, as mentioned. In one embodiment, in the process of the present invention the activity of a YOR353C protein is increased or generated, e.g. from *Saccharomyces cerevisiae* or a homolog thereof, preferably linked at least to one transit peptide as mentioned for example in table V.

In another embodiment, in the process of the present invention the activity of an YOR353C protein is increased or generated in a subcellular compartment of the organism or organism cell such as in an organelle like a plastid or mitochondria.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase" which catalyzes the first step in aromatic amino acid biosynthesis and is feedback-inhibited by phenylalanine (Aro3p). Accordingly, in one embodiment, the process of the present invention comprises the use of a "3-deoxy-D-arabino-heptulosonate-7-phosphate synthase" or its homolog, e.g. as shown herein, for the production of the fine chemical, meaning of tryptophane, in particular for increasing the amount of tryptophane in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of an YDR035W protein is increased or generated in a subcellular compartment of the organism or organism cell such as in an organelle like a plastid or mitochondria.

The sequence of YER024W (Accession number NP_010941) from *Saccharomyces cerevisiae* has been published in Goffeau et al., Science 274 (5287), 546-547, 1996 and Dietrich et al., Nature 387 (6632 Suppl), 78-81 (1997) and its activity is being defined as carnithine actyltransferase. Accordingly, in one embodiment, the process of the present invention comprises the use of a carnithine actyltransferase or its homolog, e.g. as shown herein, for the production of the fine chemical, meaning of tryptophane, in particular for increasing the amount of tryptophane in free or bound form in an organism or a part thereof, as mentioned. In one embodiment, in the process of the present invention the activity of a YER024W protein is increased or generated, e.g. from *Saccharomyces cerevisiae* or a homolog thereof, preferably linked at least to one transit peptide as mentioned for example in table V.

In another embodiment, in the process of the present invention the activity of a YER024W protein is increased or generated in a subcellular compartment of the organism or organism cell such as in an organelle like a plastid or mitochondria.

The sequence of YNL241C (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as a "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of tryptophane, in particular for increasing the amount of tryptophane in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V. In another embodiment, in the process of the present invention the activity of an YNL241C protein is increased or generated in a subcellular compartment of the organism or organism cell such as in an organelle like a plastid or mitochondria.

In one embodiment, the homolog of the YOR353C, YDR035W, YER024W and/or YNL241C, is a homolog having said activity and being derived from Eukaryot. In one embodiment, the homolog of the b1223, b1704, b2601, b2965 and/or b3390 is a homolog having said activity and being derived from bacteria. In one embodiment, the homolog of the YOR353C, YDR035W, YER024W and/or YNL241C is a homolog having said activity and being derived from Fungi. In one embodiment, the homolog of the b1223, b1704, b2601, b2965 and/or b3390 is a homolog having said activity and being derived from Proteobacteria. In one embodiment, the homolog of the YOR353C, YDR035W, YER024W and/or YNL241C is a homolog having said activity and being derived from Ascomycota. In one embodiment, the homolog of the b1223, b1704, b2601, b2965 and/or b3390 is a homolog having said activity and being derived from Gammaproteobacteria. In one embodiment, the homolog of the YOR353C, YDR035W, YER024W and/or YNL241C is a homolog having said activity and being derived from *Saccharomycotina*. In one embodiment, the homolog of the b1223, b1704, b2601, b2965 and/or b3390 is a homolog having said activity and being derived from Enterobacteriales. In one embodiment, the homolog of the YOR353C, YDR035W, YER024W and/or YNL241C is a homolog having said activity and being derived from *Saccharomycetes*. In one embodiment, the homolog of the b1223, b1704, b2601, b2965 and/or b3390 is a homolog having said activity and being derived from Enterobacteriaceae. In one embodiment, the homolog of the YOR353C, YDR035W, YER024W and/or YNL241C is a homolog having said activity and being derived from *Saccharomycetales*. In one embodiment, the homolog of the b1223, b1704, b2601, b2965 and/or b3390 is a homolog having said activity and being derived from *Escherichia*, preferably from *Escherichia coli*. In one embodiment, the homolog of the YOR353C, YDR035W, YER024W and/or YNL241C is a homolog having said activity and being derived from Saccharomycetaceae. In one embodiment, the homolog of the YOR353C, YDR035W, YER024W and/or YNL241C is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 3, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 3, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 3, column 3, or which has at least 10% of the original enzymatic activity, preferably 20%, particularly preferably 30%, most particularly preferably 40% in comparison to a protein as shown in table II, application no. 3, column 3 of *Saccharomyces cerevisiae*.

for the disclosure of the paragraphs [0040.0.0.2] to [0047.0.0.2] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 3, column 3 its biochemical or genetical causes and the increased amount of the fine chemical.

for the disclosure of the paragraphs [0049.0.0.2] to [0051.0.0.2] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 3, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.2] to [0058.0.0.2] see paragraphs [0053.0.0.0] to [0058.0.0.0] above.

In case the activity of the *Escherichia coli* protein b1223 or its homologs, e.g. a "nitrite extrusion protein" is increased advantageously in an organelle such as a plastid or mitochondria, preferably, in one embodiment an increase of the fine chemical, preferably of tryptophane between 40% and 147% or more is conferred.

In case the activity of the *Escherichia coli* protein b1704 or its homologs, e.g. a "3-deoxy-D-arabinoheptulosonate-7-phosphate synthase" is increased advantageously in an organelle such as a plastid or mitochondria, preferably, in one embodiment an increase of the fine chemical, preferably of tryptophane between 305% and 1711% or more is conferred.

In case the activity of the *Escherichia coli* protein b2601 or its homologs, e.g. an "3-deoxy-D-arabinoheptulosonate-7-phosphate synthase" is increased advantageously in an organelle such as a plastid or mitochondria, preferably, in one embodiment an increase of the fine chemical, preferably of tryptophane between 54% and 292% or more is conferred.

In case the activity of the *Escherichia coli* protein b2965 or its homologs, e.g. an "ornithine decarboxylase isozyme" is increased advantageously in an organelle such as a plastid or mitochondria, preferably, in one embodiment an increase of the fine chemical, preferably of tryptophane between 33% and 357% or more is conferred.

In case the activity of the *Escherichia coli* protein b3390 or its homologs, e.g. an "shikimate kinase I" is increased advantageously in an organelle such as a plastid or mitochondria, preferably, in one embodiment an increase of the fine chemical, preferably of tryptophane between 31% and 356% or more is conferred.

In case the activity of the *Saccharomyces cerevisiae* protein YOR353C or its homologs, e.g. a "protein required for cell morphogenesis and cell separation after mitosis; Sog2p" is increased advantageously in an organelle such as a plastid or mitochondria, preferably, in one embodiment an increase of the fine chemical, preferably of tryptophane between 30% and 129% or more is conferred.

In case the activity of the *Saccharomyces cerevisiae* protein YDR035W or its homologs, e.g. a "3-deoxy-D-arabinoheptulosonate-7-phosphate synthase" is increased advantageously in an organelle such as a plastid or mitochondria, preferably, in one embodiment an increase of the fine chemical, preferably of tryptophane between 39% and 144% or more is conferred.

In case the activity of the *Saccharomyces cerevisiae* protein YER024W or its homologs, e.g. a "putative homolog of the carnitine acetyltransferase" with a role in ubiquinone is increased advantageously in an organelle such as a plastid or mitochondria, preferably, in one embodiment an increase of the fine chemical, preferably of tryptophane between 27% and 38% or more is conferred.

In case the activity of the *Saccharomyces cerevisiae* protein YNL241C or its homologs, e.g. an "glucose-6-phosphate dehydrogenase" is increased advantageously in an organelle such as a plastid or mitochondria, preferably, in one embodiment an increase of the fine chemical, preferably of tryptophane between 30% and 43% or more is conferred.

In case the activity of the *Escherichia coli* protein b1223 or its homologs, e.g. a "nitrite extrusion protein" is increased advantageously in an organelle such as a plastid or mitochondria, preferably an increase of the fine chemical and of proteins containing tryptophane is conferred.

In case the activity of the *Escherichia coli* protein b1704 or its homologs, e.g. a "3-deoxy-D-arabinoheptulosonate-7-phosphate synthase" is increased advantageously in an organelle such as a plastid or mitochondria, preferably an increase of the fine chemical and of proteins containing tryptophane is conferred.

In case the activity of the *Escherichia coli* protein b2601 or its homologs, e.g. an "3-deoxy-D-arabinoheptulosonate-7-phosphate synthase" is increased advantageously in an organelle such as a plastid or mitochondria, preferably an increase of the fine chemical and of proteins containing tryptophane is conferred.

In case the activity of the *Escherichia coli* protein b2965 or its homologs, e.g. an "ornithine decarboxylase isozyme" is increased advantageously in an organelle such as a plastid or mitochondria, preferably an increase of the fine chemical and of proteins containing tryptophane is conferred.

In case the activity of the *Escherichia coli* protein b3390 or its homologs, e.g. an "shikimate kinase I" is increased advantageously in an organelle such as a plastid or mitochondria, preferably an increase of the fine chemical and of proteins containing tryptophane is conferred.

In case the activity of the *Saccharomyces cerevisiae* protein YOR353C or its homologs, e.g. a "protein required for cell morphogenesis and cell separation after mitosis; Sog2p" is increased advantageously in an organelle such as a plastid or mitochondria, preferably an increase of the fine chemical and of proteins containing tryptophane is conferred.

In case the activity of the *Saccharomyces cerevisiae* protein YDR035W or its homologs, e.g. a "3-deoxy-D-arabinohep-tulosonate-7-phosphate synthase" is increased advantageously in an organelle such as a plastid or mitochondria, preferably an increase of the fine chemical and of proteins containing tryptophane is conferred.

In case the activity of the *Saccharomyces cerevisiae* protein YER024W or its homologs, e.g. a "putative homolog of the carnitine acetyltransferase" is increased advantageously in an organelle such as a plastid or mitochondria, preferably an increase of the fine chemical and of proteins containing tryptophane is conferred.

In case the activity of the *Saccharomyces cerevisiae* protein YNL241C or its homologs, e.g. an "glucose-6-phosphate dehydrogenase" is increased advantageously in an organelle such as a plastid or mitochondria, preferably an increase of the fine chemical and of proteins containing tryptophane is conferred.

for the disclosure of the paragraphs [0061.0.0.2] and [0062.0.0.2] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 3, column 7 or of the polypeptide as shown in the amino acid sequences as disclosed in table II, application no. 3, columns 5 and 7 or the functional homologues thereof as described herein, or is encoded by the nucleic acid molecule characterized herein or the nucleic acid molecule according to the invention, for example by the nucleic acid molecule as shown in table I, application no. 3, columns 5 and 7 or its herein described functional homologues and has the herein mentioned activity.

For the purposes of the present invention, the terms "L-tryptophane" and "tryptophane" also encompass the corresponding salts, such as, for example, tryptophane hydrochloride or tryptophane sulfate. Preferably the terms tryptophane is intended to encompass the term L-tryptophane.

for the disclosure of the paragraphs [0065.0.0.2] and [0066.0.0.2] see paragraphs [0065.0.0.0] and [0066.0.0.0] above.

In one embodiment, the process of the present invention comprises one or more of the following steps
a) stabilizing a protein conferring the increased expression of a protein encoded by the nucleic acid molecule of the invention or of the polypeptide of the invention, e.g. of a polypeptide having a Table II, application no. 3, columns 5 and 7 protein activity or its homologs activity having herein-mentioned tryptophane increasing activity; and/or
b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 3, columns 5 and 7, e.g. a nucleic acid sequence encoding a polypeptide having a Table II, application no. 3, columns 5 and 7 protein activity or its homologs or of a mRNA encoding the polypeptide of the present invention having herein-mentioned tryptophane increasing activity; and/or
c) increasing the specific activity of a protein conferring the increased expression of a protein encoded by the nucleic acid molecule of the invention or of the polypeptide of the present invention having herein-mentioned tryptophane increasing activity, e.g. of a polypeptide having a Table II, application no. 3, columns 5 and 7 protein or its homologs activity, or decreasing the inhibitory regulation of the polypeptide of the invention; and/or
d) generating or increasing the expression of an endogenous or artificial transcription factor mediating the expression of a protein conferring the increased expression of a protein encoded by the nucleic acid molecule of the invention or of the polypeptide of the invention having herein-mentioned tryptophane increasing activity, e.g. of a polypeptide having the Table II, application no. 3, columns 5 and 7 protein or its homologs activity; and/or
e) stimulating activity of a protein conferring the increased expression of a protein encoded by the nucleic acid molecule of the present invention or a polypeptide of the present invention having herein-mentioned tryptophane increasing activity, e.g. of a polypeptide having the Table II, application no. 3, columns 5 and 7 protein or its homologs activity, by adding one or more exogenous inducing factors to the organisms or parts thereof; and/or
f) expressing a transgenic gene encoding a protein conferring the increased expression of a polypeptide encoded by the nucleic acid molecule of the present invention or a polypeptide of the present invention, having herein-mentioned tryptophane increasing activity, e.g. of a polypeptide having the Table II, application no. 3, columns 5 and 7 protein or its homologs, and/or
g) increasing the copy number of a gene conferring the increased expression of a nucleic acid molecule encoding a polypeptide encoded by the nucleic acid molecule of the invention or the polypeptide of the invention having herein-mentioned tryptophane increasing activity, e.g. of a polypeptide having the Table II, application no. 3, columns 5 and 7 protein or its homologs; and/or
h) increasing the expression of the endogenous gene encoding the polypeptide of the invention, e.g. a polypeptide having the Table II, application no. 3, columns 5 and 7 protein or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or
i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or
j) selecting of organisms with especially high activity of the proteins of the invention from natural or from mutagenized resources and breeding them into the target organisms, e.g. the elite crops; and/or
k) directing a protein encoded by the nucleic acid molecule of the invention or of the polypeptide of the present invention having herein-mentioned tryptophane increasing activity, e.g. of a polypeptide having a Table II, application no. 3, columns 5 and 7 protein or its homologs activity, to the plastids by the addition of a plastidial targeting sequence; and/or l) generating the expression of a protein encoded by the nucleic acid molecule of the invention or of the polypeptide of the present invention having herein-mentioned tryptophane increasing activity, e.g. of a polypeptide having a Table II, application no. 3, columns 5 and 7 protein or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned tryptophane increasing activity, e.g. of a polypeptide having a Table II, application no. 3, columns 5 and 7 protein or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 3, column 3 or its homologs. Preferably the increase of the fine chemical takes place in plastids.

for the disclosure of the paragraphs [0069.0.0.2] to [0079.0.0.2] see paragraphs [0069.0.0.0] to [0079.0.0.0] above.

The activation of an endogenous polypeptide having above-mentioned activity, e.g. having the activity of a protein as shown in table II, application no. 3, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 3, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 3, column 3. The expression of the chimeric transcription factor in a organism, in particular in a plant, leads to a specific expression of the protein as shown in table II, application no. 3, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.2] to [0084.0.0.2] see paragraphs [0081.0.0.0] to [0084.0.0.0] above.

Owing to the introduction of a gene or a plurality of genes conferring the expression of the nucleic acid molecule of the invention or the polypeptide of the invention, for example the nucleic acid construct mentioned below, or encoding the protein as shown in table II, application no. 3, column 3 into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutrional physiology limited) amino acids, like methionine, lysine or threonine alone or in combination in free or bound form.

for the disclosure of this paragraph see paragraph [0086.0.0.0] above.

By influencing the metabolism thus, it is possible to produce, in the process according to the invention, further advantageous compounds. Examples of such compounds are, in addition to tryptophane for example compounds like amino acids such as methionine, threonine or lysine or other desirable compounds.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 3, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound amino acids, in particular tryptophane.

for the disclosure of the paragraphs [0090.0.0.2] to [0097.0.0.2] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 3, columns 5 and 7 or a derivative thereof, or b) a genetic regulatory element, for example a promoter, which is functionally linked to the nucleic acid sequence as shown table I, application no. 3, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 3, columns 5 and 7 joined to a nucleic acid sequence encoding a transit peptide, or a targeting nucleic acid sequence which directs the nucleic acid sequences disclosed in table I, application no. 3, columns 5 and 7 to the organelle preferentially the plastids. Altenatively the inventive nucleic acids sequences consist advantageously of the nucleic acid sequences as depicted in the sequence protocol and disclosed in table I, application no. 3, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above. [0101.0.2.2] In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine. After the activity of the protein as shown in table II, application no. 3, column 3 has been increased or generated in the cytsol or plastids, preferentially in the plastids, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.2] to [0110.0.0.2] see paragraphs [0102.0.0.0] to [0110.0.0.0] above.

In a preferred embodiment, the fine chemical (tryptophane) is produced in accordance with the invention and, if desired, is isolated. The production of further amino acids such as lysine, tryptophane etc. and of amino acid mixtures by the process according to the invention is advantageous.

for the disclosure of the paragraphs [0112.0.0.2] to [0115.0.0.2] see paragraphs [0112.0.0.0] to [0115.0.0.0] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 3, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 3, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table III, application no. 3, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 3, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 3, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 3, columns 5 and 7 by one or more nucleotides. In one embodiment, the nucleic acid molecule used in the process of the invention does not consist of the sequence indicated in table IA, application no. 3, columns 5 and 7. In one embodiment, the nucleic acid molecule used in the process of the invention is less than 100%, 99.999%, 99.99%, 99.9% or 99% identical to a sequence indicated in table IA, application no. 3, columns 5 and 7. In another embodiment, the nucleic acid molecule does not encode a polypeptide of a sequence indicated in table IIA, application no. 3, columns 5 and 7.

In one embodiment, the nucleic acid molecule used in the process of the invention distinguishes over the sequence indicated in table IB, application no. 3, columns 5 and 7, by one or more nucleotides. In one embodiment, the nucleic acid molecule used in the process of the invention does not consist of the sequence indicated in table IB, application no. 3, columns 5 and 7. In one embodiment, the nucleic acid molecule used in the process of the invention is less than 100%, 99.999%, 99.99%, 99.9% or 99% identical to a sequence indicated in table IB, application no. 3, columns 5 and 7. In another embodiment, the nucleic acid molecule does not encode a polypeptide of a sequence indicated in table IIB, application no. 3, columns 5 and 7.

In one embodiment, the nucleic acid molecule used in the process distinguishes over the sequence shown in table I, application no. 3, columns 5 and 7 by one or more nucleotides or does not consist of the sequence shown in table I, application no. 3, columns 5 and 7. In one embodiment, the nucleic acid molecule of the present invention is less than 100%, 99.999%, 99.99%, 99.9% or 99% identical to the sequence shown in table I, application no. 3, columns 5 and 7. In another embodiment, the nucleic acid molecule does not encode a polypeptide of the sequence shown in table II, application no. 3, columns 5 and 7.

for the disclosure of the paragraphs [0118.0.0.2] to [0120.0.0.2] see paragraphs [0118.0.0.0] to [0120.0.0.0] above.

Nucleic acid molecules with the sequence shown in table I, application no. 3, columns 5 and 7, nucleic acid molecules which are derived from the amino acid sequences shown in table II, application no. 3, columns 5 and 7 or from polypeptides comprising the consensus sequence shown in table IV, application no. 3, column 7, or their derivatives or homologues encoding polypeptides with the enzymatic or biological activity of a protein as shown in table II, application no. 3, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above. [0123.0.2.2] Nucleic acid molecules, which are advantageous for the process according to the invention and which encode polypeptides with the activity of a protein as shown in table II, application no. 3, column 3 can be determined from generally accessible databases.

for the disclosure of this paragraph see paragraph [0124.0.0.0] above. [0125.0.2.2] The nucleic acid molecules used in the process according to the invention take the form of isolated nucleic acid sequences, which encode polypeptides with the activity of the proteins as shown in table II, application no. 3, column 3 and conferring the fine chemical increase by expression either in the cytsol or in an organelle such as a plastid or mitochondria or both, preferably in plastids.

for the disclosure of the paragraphs [0126.0.0.2] to [0133.0.0.2] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 3, columns 5 and 7 or the functional homologues thereof as described herein, preferably conferring above-mentioned activity, i.e. conferring the fine chemical increase after increasing its activity, e.g. after increasing the activity of a protein as shown in table II, column 3 by for example expression either in the cytsol or in an organelle such as a plastid or mitochondria or both, preferably in plastids.

for the disclosure of the paragraphs [0135.0.0.2] to [0140.0.0.2] see paragraphs [0135.0.0.0] to [0140.0.0.0] above.

Synthetic oligonucleotide primers for the amplification, e.g. as shown in table III, application no. 3, column 7, by means of polymerase chain reaction can be generated on the basis of a sequence shown herein, for example the sequence shown in table I, application no. 3, columns 5 and 7 or the sequences derived from table II, application no. 3, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 3, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 3, column 3 or further functional homologs of the polypeptide of the invention from other organisms.

for the disclosure of the paragraphs [0144.0.0.2] to [0151.0.0.2] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 3, columns 5 and 7, preferably shown in table IB, application no. 3, columns 5 and 7 under relaxed hybridization conditions and which code on expression for peptides having the methionine increasing activity.

for the disclosure of the paragraphs [0153.0.0.2] to [0159.0.0.2] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 3, columns 5 and 7, preferably shown in table IB, application no. 3, columns 5 and 7 is one which is sufficiently complementary to one of the nucleotide sequences shown in table I, application no. 3, columns 5 and 7, preferably shown in table IB, application no. 3, columns 5 and 7 such that it can hybridize to one of the nucleotide sequences shown in table I, application no. 3, columns 5 and 7, preferably shown in table IB, application no. 3, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 3, columns 5 and 7, preferably shown in table IB, application no. 3, columns 5 and 7, or a portion thereof and preferably has above mentioned activity, in particular having a fine chemical increasing activity after increasing the activity or an activity of a gene product as shown in table II, application no. 3, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 3, columns 5 and 7, preferably shown in table IB, application no. 3, columns 5 and 7, or a portion thereof and encodes a protein having above-mentioned activity, e.g. conferring of a tryptophane increase by for example expression either in the cytsol or in an organelle such as a plastid or mitochondria or both, preferably in plastids, and optionally, the activity of a protein as shown in table II, application no. 3, column 3.

Moreover, the nucleic acid molecule of the invention can comprise only a portion of the coding region of one of the sequences shown in table I, application no. 3, columns 5 and 7, preferably shown in table IB, application no. 3, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 3, columns 5 and 7, preferably shown in table IB, application no. 3, columns 5 and 7, an anti-sense sequence of one of the sequences, e.g., set forth in table I, application no. 3, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 3, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 3, columns 5 and 7 such that the protein or portion thereof maintains the ability to participate in the fine chemical production, in particular a tryptophane increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 3, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 3, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.2] and [0169.0.0.2] see paragraphs [0168.0.0.0] to [0169.0.0.0] above.

The invention further relates to nucleic acid molecules that differ from one of the nucleotide sequences shown in table I, application no. 3, columns 5 and 7 (and portions thereof due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 3, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 3, columns 5 and 7 or the functional homologues. In a still further embodiment, the nucleic acid molecule of the invention encodes a full length protein which is substantially homologous to an amino acid sequence shown in table II, application no. 3, columns 5 and 7 or the functional homologues. However, in a preferred embodiment, the nucleic acid molecule of the present invention does not consist of the sequence shown in table I, application no. 3, columns 5 and 7, preferably as indicated in table IA, application no. 3, columns 5 and 7. Preferably the nucleic acid molecule of the invention is a functional homologue or identical to a nucleic acid molecule indicated in table IB, application no. 3, columns 5 and 7.

for the disclosure of the paragraphs [0171.0.0.2] to [0173.0.0.2] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 3, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 3, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having abovementioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 3, columns 5 and 7.

for the disclosure of the paragraphs [0179.0.0.2] and [0180.0.0.2] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 3, columns 5 and 7, preferably shown in table IIA, application no. 3, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 3, columns 5 and 7, preferably shown in table IIA, application no. 3, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 3, columns 5 and 7, preferably shown in table IIA, application no. 3, columns 5 and 7, more preferably at least about 70% identical to one of the sequences shown in table II, application no. 3, columns 5 and 7, preferably shown in table IIA, application no. 3, columns 5 and 7, even more preferably at least about 80%, 90%, 95% homologous to the sequence shown in table II, application no. 3, columns 5 and 7, preferably shown in table IIA, application no. 3, columns 5 and 7, and most preferably at least about 96%, 97%, 98%, or 99% identical to the sequence shown in table II, application no. 3, columns 5 and 7, preferably shown in table IIA, application no. 3, columns 5 and 7.

for the disclosure of the paragraphs [0182.0.0.2] to [0188.0.0.2] see paragraphs [0182.0.0.0] to [0188.0.0.0] above.

Functional equivalents derived from one of the polypeptides as shown in table II, application no. 3, columns 5 and 7, preferably shown in table IIB, application no. 3, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 3, columns 5 and 7, preferably shown in table IIB, application no. 3, columns 5 and 7 resp., according to the invention and are distinguished by essentially the same properties as the polypeptide as shown in table II, application no. 3, columns 5 and 7, preferably shown in table IIB, application no. 3, columns 5 and 7.

Functional equivalents derived from the nucleic acid sequence as shown in table I, application no. 3, columns 5 and 7, preferably shown in table IB, application no. 3, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 3, columns 5 and 7, preferably shown in table IIB, application no. 3, columns 5 and 7 resp., according to the invention and encode polypeptides having essentially the same properties as the polypeptide as shown in table II, application no. 3, columns 5 and 7, preferably shown in table IIB, application no. 3, columns 5 and 7.

for the disclosure of this paragraph see paragraph [0191.0.0.0] above.

A nucleic acid molecule encoding an homologous to a protein sequence of table II, application no. 3, columns 5 and 7, preferably shown in table IIB, application no. 3, columns 5 and 7 resp., can be created by introducing one or more nucleotide substitutions, additions or deletions into a nucleotide sequence of the nucleic acid molecule of the present invention, in particular of table I, application no. 3, columns 5 and 7, preferably shown in table IB, application no. 3, columns 5 and 7 resp., such that one or more amino acid substitutions, additions or deletions are introduced into the encoded protein. Mutations can be introduced into the encoding sequences of table I, application no. 3, columns 5 and 7, preferably shown in table IB, application no. 3, columns 5 and 7 resp., by standard techniques, such as site-directed mutagenesis and PCR-mediated mutagenesis.

for the disclosure of the paragraphs [0193.0.0.2] to [0196.0.0.2] see paragraphs [0193.0.0.0] to [0196.0.0.0] above.

Homologues of the nucleic acid sequences used, with the sequence shown in table I, application no. 3, columns 5 and 7, preferably shown in table IB, application no. 3, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 3, columns 5 and 7, preferably shown in table IB, application no. 3, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 3, columns 5 and 7, preferably shown in table IB, application no. 3, columns 5 and 7. It is preferred that the nucleic acid molecule comprises as little as possible other nucleotides not shown in any one of table I, application no. 3, columns 5 and 7, preferably shown in table IB, application no. 3, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 3, columns 5 and 7, preferably shown in table IB, application no. 3, columns 5 and 7.

Also preferred is that the nucleic acid molecule used in the process of the invention encodes a polypeptide comprising the sequence shown in table II, application no. 3, columns 5 and 7, preferably shown in table IIB, application no. 3, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 3, columns 5 and 7, preferably shown in table IIB, application no. 3, columns 5 and 7.

In one embodiment, the nucleic acid molecule of the invention or used in the process encodes a polypeptide comprising the sequence shown in table II, application no. 3, columns 5 and 7, preferably shown in table IIB, application no. 3, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 3, columns 5 and 7, preferably shown in table IB, application no. 3, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 3, columns 5 and 7 expressed under identical conditions.

Homologues of table I, application no. 3, columns 5 and 7 or of the derived sequences of table II, application no. 3, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.2] to [0215.0.0.2] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 3, columns 5 and 7, preferably in Table IIB, application no. 3, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 3, columns 5 and 7, preferably in Table IB, application no. 3, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 3, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 3, columns 7 and conferring an increase in the amount of the fine chemical in an organism or a part thereof;

k) nucleic acid molecule encoding the amino acid sequence of a polypeptide encoding a domain of the polypeptide shown in table II, application no. 3, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 3, columns 5 and 7 or a nucleic acid molecule encoding, preferably at least the mature form of, the polypeptide shown in table II, application no. 3, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 3, columns 5 and 7 by one or more nucleotides. In one embodiment, the nucleic acid molecule of the invention does not consist of the sequence shown in table IA and/or IB, application no. 3, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 3, columns 5 and 7. In a further embodiment the nucleic acid molecule does not encode the polypeptide sequence shown in table IIA and/or IIB, application no. 3, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 3, columns 5 and 7 does not encode a protein of the sequence shown in table IIA and/or IIB, application no. 3, columns 5 and 7. Accordingly, in one embodiment, the protein encoded by a sequence of a nucleic acid according to (a) to (l) does not consist of the sequence shown in table IA and/or IB, application no. 3, columns 5 and 7. In a further embodiment, the protein of the present invention is at least 30% identical to protein sequence depicted in table IIA and/or IIB, application no. 3, columns 5 and 7 and less than 100%, preferably less than 99.999%, 99.99% or 99.9%, more preferably less than 99%, 985, 97%, 96% or 95% identical to the sequence shown in table IIA and/or IIB, application no. 3, columns 5 and 7.

for the disclosure of the paragraphs [0217.0.0.2] to [0226.0.0.2] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 3, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.2] to [0239.0.0.2] see paragraphs [0228.0.0.0] to [0239.0.0.0] above.

In addition to the sequence mentioned in table I, application no. 3, columns 5 and 7 or its derivatives, it is advantageous additionally to express and/or mutate further genes in the organisms. Especially advantageously, additionally at least one further gene of the amino acid biosynthetic pathway such as for L-lysine, L-threonine, L-trptophane and/or L-methionine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the nucleic acids sequences of the invention containing the sequences shown in table I, application no. 3, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.0.2] to [0264.0.0.2] see paragraphs [0241.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 3, columns 5 and 7 and described herein to achieve an expression in one of said compartments or extracellular.

for the disclosure of the paragraphs [0266.0.0.2] to [0287.0.0.2] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 3, columns 5 and 7 or their homologs is functionally linked to a plastidial targeting sequence. A further preferred embodiment of the invention relates to a vector in which a nucleic acid sequence encoding one of the polypeptides shown in table II, application no. 3, columns 5 and 7 or their homologs is functionally linked to a regulatory sequences which permit the expression in plastids.

for the disclosure of the paragraphs [0289.0.0.2] to [0296.0.0.2] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b1223, anti-b1704, anti-b2601, anti-b2965, anti-b3390, anti-YOR353C, anti-YDR035W, anti-YER024 and/or anti-YNL241C protein antibody or an antibody against polypeptides as shown in table II, application no. 3, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 3, columns 5 and 7 or as coded by the nucleic acid molecule shown in table I, application no. 3, columns 5 and 7 or functional homologues thereof.

In one advantageous embodiment, in the method of the present invention the activity of a polypeptide is increased comprising or consisting of the consensus sequence shown in table IV, application no. 3, columns 7 and in one another embodiment, the present invention relates to a polypeptide comprising or consisting of the consensus sequence shown in table IV, application no. 3, columns 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.2] to [0304.0.0.2] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 3, columns 5 and 7 by one or more amino acids. In one embodiment, polypeptide distinguishes form the sequence shown in table IIA and/or IIB, application no. 3, columns 5 and 7 by more than 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from the sequence shown in table IIA and/or IIB, application no. 3, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 3, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 3, columns 5 and 7 by one or more amino acids. In another embodiment, said polypeptide of the invention does not consist of the sequence shown in table IIA and/or IIB, application no. 3, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 3, columns 5 and 7.

In one embodiment, the present invention relates to a polypeptide having the activity of the protein as shown in table IIA and/or IIB, application no. 3, column 3, which distinguishes over the sequence depicted in table IIA and/or IIB, application no. 3, columns 5 and 7 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.2] to [0311.0.0.2] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table IIA and/or IIB, application no. 3, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 3, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 3, columns 5 and 7 or which is homologous thereto, as defined above.

Accordingly the polypeptide of the present invention can vary from the sequences shown in table IIA and/or IIB, application no. 3, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 3, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 3, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 3, column 3. Differences shall mean at least one amino acid different from the sequences as shown in table II, application no. 3, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 3, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 3, column 3. The nucleic acid molecules and polypeptide molecules of the invention are expressed such that the yield, production, and/or efficiency of production of a desired compound is improved.

for the disclosure of the paragraphs [0320.0.0.2] to [0322.0.0.2] see paragraphs [0320.0.0.0] to [0322.0.0.0] above.

In one embodiment, a protein (=polypeptide) as shown in table II, application no. 3, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 3, column 3, e.g., a protein which does not confer the activity described herein and which is derived from the same or a different organism.

for the disclosure of the paragraphs [0324.0.0.2] to [0329.0.0.2] see paragraphs [0324.0.0.0] to [0329.0.0.0] above.

In an especially preferred embodiment, the polypeptide according to the invention furthermore also does not have the sequences of those proteins which are encoded by the sequences shown in table II, application no. 3, columns 5 and 7.

for the disclosure of the paragraphs [0331.0.0.2] to [0346.0.0.2] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 3, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 3, column 3 or a protein as shown in table II, application no. 3, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 3, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.2] to [0369.0.0.2] see paragraphs [0350.0.0.0] to [0369.0.0.0] above.

The fermentation broths obtained in this way, containing in particular L-phenylalanine, L-tyrosine and/or L-tryptophane preferably L-tryptophane, normally have a dry matter content of from 7.5 to 25% by weight. The fermentation broth can be processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

for the disclosure of the paragraphs [0371.0.0.2] to [0376.0.0.2], [0376.1.0.2] and [0377.0.0.2] see paragraphs [0371.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting, e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 3, columns 5 and 7, preferably in table IB, application no. 3, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.2] to [0383.0.0.2] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 3, column 3, e.g. comparing near identical organisms with low and high activity of the proteins as shown in table II, application no. 3, column 3.

for the disclosure of the paragraphs [0385.0.0.2] to [0435.0.0.2] see paragraphs [0385.0.0.0] to [0435.0.0.0] above.

Trytophane Production in *Chlamydomonas reinhardtii*

The amino acid production can be analysed as mentioned above. The proteins and nucleic acids can be analysed as mentioned below.

for the disclosure of the paragraphs [0437.0.0.2] to [0497.0.0.2] see paragraphs [0437.0.0.0] to [0497.0.0.0] above.

The results of the different plant analyses can be seen from the table, which follows:

TABLE VI

| ORF | Metabolite | Method | Min | Max |
| --- | --- | --- | --- | --- |
| YOR353C | Tryptophane | LC | 1.30 | 2.29 |
| YDR035W | Tryptophane | LC | 1.39 | 2.44 |
| YER024W | Tryptophane | LC | 1.27 | 1.38 |
| YNL241C | Tryptophane | LC | 1.30 | 1.43 |
| b1223 | Tryptophane | LC | 1.40 | 2.47 |
| b3390 | Tryptophane | LC + GC | 1.31 | 4.56 |
| b1704 | Tryptophane | LC | 4.05 | 18.11 |
| b2601 | Tryptophane | LC | 1.54 | 3.92 |
| b2965 | Tryptophane | LC | 1.33 | 4.57 | for the disclosure of the paragraphs [0499.0.0.2] and [0500.0.0.2] see paragraphs [0499.0.0.0] and [0500.0.0.0] above.

Example 15a

Engineering Ryegrass Plants by Over-Expressing YDR03W from *Saccharomyces cerevisiae* or Homologs of YDR03W from Other Organisms for the disclosure of the paragraphs [0502.0.0.2] to [0508.0.0.2] see paragraphs [0502.0.0.0] to [0508.0.0.0] above.

Example 15b

Engineering Soybean Plants by Over-Expressing YDR03W from *Saccharomyces cerevisiae* or Homologs of YDR03W from Other Organisms for the disclosure of the paragraphs [0510.0.0.2] to [0513.0.0.2] see paragraphs [0510.0.0.0] to [0513.0.0.0] above.

Example 15c

Engineering Corn Plants by Over-expressing YDR03W from *Saccharomyces cerevisiae* or Homologs of YDR03W from Other Organisms for the disclosure of the paragraphs [0515.0.0.2] to [0540.0.0.2] see paragraphs [0515.0.0.0] to [0540.0.0.0] above.

Example 15d

Engineering Wheat Plants by Over-expressing YDR03W from *Saccharomyces cerevisiae* or Homologs of YDR03W from Other Organisms for the disclosure of the paragraphs [0542.0.0.2] to [0544.0.0.2] see paragraphs [0542.0.0.0] to [0544.0.0.0] above.

Example 15e

Engineering Rapeseed/Canola Plants by Over-expressing YDR03W from *Saccharomyces cerevisiae* or Homologs of YDR03W from Other Organisms for the disclosure of the paragraphs [0546.0.0.2] to [0549.0.0.2] see paragraphs [0544.0.0.0] to [0549.0.0.0] above.

Example 15f

Engineering Alfalfa Plants by Over-expressing YDR03W from *Saccharomyces cerevisiae* or Homologs of YDR03W from Other Organisms for the disclosure of the paragraphs [0551.0.0.2] to [0554.0.0.2] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropiate control plants. The results are shown in table VII

TABLE VII

| ORF_NAME | Metabolite | MIN | MAX |
|---|---|---|---|
| b2601 | Tryptophane | 1.67 | 8.26 |
| YDR035W | Tryptophane | 1.39 | 3.19 |

Table VII shows the increase in methionine in genetically modified corn plants expressing the *Escherichia coli* nucleic acid sequence b2601 or the *Saccharomyces cerevisiae* nucleic acid sequence YDR035W.

In one embodiment, in case the activity of the *Escherichia coli* protein b2601 or its homologs, e.g. a 3-deoxy-D-arabino-heptulosonate-7-phosphate synthase (DAHP synthetase, tyrosine-repressible)", is increased in corn plants, preferably, an increase of the fine chemical tryptophane between 67% and 726% or more is conferred.

In one embodiment, in case the activity of the *Saccharomyces cerevisiae* protein YDR035W or its homologs, e.g. a "3-deoxy-D-arabino-heptulosonate-7-phosphate (DAHP) synthase", is increased in corn plants, preferably, an increase of the fine chemical tryptophane between 39% and 219% or more is conferred.

for the disclosure of this paragraph see [0554.2.0.0] above.
for the disclosure of this paragraph see [0555.0.0.0] above.
for the disclosure of the paragraphs [0001.0.0.3] to [0007.0.0.3] see paragraphs [0001.0.0.0] to [0007.0.0.0] above.
for the disclosure of the paragraphs [0007.1.0.3] and [0008.0.0.3] see paragraphs [0007.1.0.0] and [0008.0.0.0] above.

As described above, the essential amino acids are necessary for humans and many mammals, for example for livestock. The branched-chain amino acids (BCAA) leucine, isoleucine and valine are among the nine dietary indispensable amino acids for humans. BCAA accounts for 35-40% of the dietary indispensable amino acids in body protein and 14% of the total amino acids in skeletal muscle (Ferrando et al., (1995) Oral branched chain amino acids decrease whole-body proteolysis. J. Parenter. Enteral Nutr. 19: 47-54. 13). They share a common membrane transport system and enzymes for their transamination and irreversible oxidation (Block, K. P. (1989) Interactions among leucine, isoleucine, and valine with special reference to the branched chain amino acid antagonism. In: Absorption and Utilization of Amino Acids (Friedman, M., ed.), pp. 229-244, CRC Press, Boca Raton, Fla. and Champe, P. C. & Harvey, R. A. (1987) Amino acids: metabolism of carbon atoms. In: Biochemistry (Champ, P. C. & Harvery, P. A., eds.), pp. 242-252, J. B. Lippincott, Philadelphia, Pa.). Further, for patient suffering from Maple Syrup Urine Disease (MSUD) a reduced uptake of those branched-chain amino acids is essential.

Dietary sources of the branched-chain amino acids are principally derived from animal and vegetable proteins. The branched-chain amino acids (BCAA) leucine, isoleucine and valine are marginal or limiting for many mammals. Furthermore the adverse balance of leucine to isoleucine and valine for the production of proteins in mammals. Therefor the branched-chain amino acids are supplemented in broiler, leg hens, turkey, swine or cattle diets.

for the disclosure of the paragraphs [0010.0.0.3] and [0011.0.0.3] see paragraphs [0010.0.0.0] and [0011.0.0.0] above.

It is an object of the present invention to develop an inexpensive process for the synthesis of leucine, isoleucine and/or valine, preferably L-leucine, L-isoleucine and/or L-valine.

for the disclosure of this paragraph see [0013.0.0.0] above.

Accordingly, in a first embodiment, the invention relates to a process for the production of a fine chemical, whereby the fine chemical is leucine, isoleucine and/or valine, preferably L-leucine, L-isoleucine and/or L-valine. Accordingly, in the present invention, the term "the fine chemical" as used herein relates to "leucine, isoleucine and/or valine". Further, the term "the fine chemicals" as used herein also relates to fine chemicals comprising leucine, isoleucine and/or valine.

In one embodiment, the term "the fine chemical" means leucine, isoleucine and/or valine. Throughout the specification the term "the fine chemical" means leucine, isoleucine and/or valine, preferably L-leucine, L-isoleucine and/or L-valine, its salts, ester or amids in free form or bound to proteins. In a preferred embodiment, the term "the fine chemical" means leucine, isoleucine and/or valine, preferably L-leucine, L-isoleucine and/or L-valine in free form or its salts or bound to proteins.

Accordingly, the present invention relates to a process for the production of leucine, isoleucine and/or valine, which comprises (a) increasing or generating the activity of a protein as shown in table II, application no. 4, column 3 encoded by the nucleic acid sequences as shown in table I, application no. 4, column 5, in an organelle of a microorganism or plant, or (b) increasing or generating the activity of a protein as shown in table II, application no. 4, column 3 encoded by the nucleic acid sequences as shown in table I, application no. 4, column 5 in the plastid of a microorganism or plant, or in one or more parts thereof; and (c) growing the organism under conditions which permit the production of the fine chemical, thus, leucine, isoleucine and/or valine or fine chemicals comprising leucine, isoleucine and/or valine, in said organism or in the culture medium surrounding the organism.

In another embodiment the present invention is related to a process for the production of leucine, isoleucine and/or valine, which comprises
(a) increasing or generating the activity of a protein as shown in table II, application no. 4, column 3 encoded by the nucleic acid sequences as shown in table I, application no. 4, column 5, in an organelle of a non-human organism, or
(b) increasing or generating the activity of a protein as shown in table II, application no. 4, column 3 encoded by the nucleic acid sequences as shown in table I, application no. 4, column 5, which are joined to a nucleic acid sequence encoding a transit peptide in a non-human organism, or in one or more parts thereof; or
(c) increasing or generating the activity of a protein as shown in table II, application no. 4, column 3 encoded by the nucleic acid sequences as shown in table I, application no. 4, column 5, which are joined to a nucleic acid sequence encoding chloroplast localization sequence, in a non-human organism, or in one or more parts thereof, and
(d) growing the organism under conditions which permit the production of leucine, isoleucine and/or valine in said organism.

In another embodiment, the present invention relates to a process for the production of leucine, isoleucine and/or valine, which comprises
(a) increasing or generating the activity of a protein as shown in table II, application no. 4, column 3 encoded by the nucleic acid sequences as shown in table I, application no. 4, column 5, in an organelle of a microorganism or plant through the transformation of the organelle, or
(b) increasing or generating the activity of a protein as shown in table II, application no. 4, column 3 encoded by the nucleic acid sequences as shown in table I, application no. 4, column 5 in the plastid of a microorganism or plant, or in one or more parts thereof through the transformation of the plastids; and
(c) growing the organism under conditions which permit the production of the fine chemical, thus, leucine, isoleucine and/or valine or fine chemicals comprising leucine, isoleucine and/or valine, in said organism or in the culture medium surrounding the organism.

Advantageously the activity of the protein as shown in table II, application no. 4, column 3 encoded by the nucleic acid sequences as shown in table I, application no. 4, column 5 is increased or generated in the abovementioned process in the plastid of a microorganism or plant.

for the disclosure of the paragraphs [0019.0.0.3] to [0024.0.0.3] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 4, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 4, column 3 and its homologs as disclosed in table I, application no. 4, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 4, column 3 and its homologs as disclosed in table I, application no. 4, columns 5 and 7.

for the disclosure of the paragraphs [0027.0.0.3] to [0029.0.0.3] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 4, columns 5 and 7. The person skilled in the art is able to join said sequences in a functional manner. Advantageously the transit peptide part is cleaved off from the protein part shown in table II, application no. 4, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 4, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 4, columns 5 and 7. In case of the amino acid sequence QIA CSS the three amino acids in front of the start methionine are stemming from the LIC (=ligation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 4, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 4, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 4, columns 5 and 7 are directly introduced and expressed in plastids. The term "introduced" in the context of this specification shall mean the insertion of a nucleic acid sequence into the organism by means of a "transfection", "transduction" or preferably by "transformation".

by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.3] and [0030.3.0.3] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 4, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 4, columns 5 and 7 or a sequence encoding a protein, as depicted in table II, application no. 4, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limited to ASBVd, PLMVd, CChMVd and ELVd. The viroid sequence or a functional part of it can be fused to the sequences depicted in table I, application no. 4, columns 5 and 7 or a sequence encoding a protein, as depicted in table II, application no. 4, columns 5 and 7 in such a manner that the viroid sequence transports a sequence transcribed from a sequence as depicted in table I, application no. 4 columns 5 and 7 or a sequence encoding a protein as depicted in table II, application no. 4 columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 4, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 4, columns 5 and 7.

In a preferred embodiment of the invention the nucleic acid sequences as shown in table I, application no. 4, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 4, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.3] and [0032.0.0.3] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 4, column 3. Preferably the modification of the activity of a protein as shown in table II, application no. 4, column 3 or their combination can be achieved by joining the protein to a transit peptide.

Surprisingly it was found, that the transgenic expression of the Saccaromyces cerevisiae protein as shown in table II, application no. 4, column 3 in plastids of a plant such as Arabidopsis thaliana for example through the linkage to at least one targeting sequence for example as mentioned in table V conferred an increase in the fine chemical content of the transformed plants.

for the disclosure of this paragraph see paragraph [0035.0.0.0] above.

The sequence of b0342 (Accession number PIR:XX-ECTG) from Escherichia coli has been published in Blattner et al., Science 277 (5331), 1453-1474 (1997), and its activity is being defined as "thiogalactoside acetyltransferase". Accordingly, in one embodiment, the process of the present invention comprises the use of a "thiogalactoside acetyltransferase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a b0342 protein is increased or generated, e.g. from Escherichia coli or a homolog thereof, preferably linked at least to one transit peptide as mentioned for example in table V.

In another embodiment, in the process of the present invention the activity of a b0342 protein is increased or generated in a subcellular compartment of the organism or organism cell such as in an organelle like a plastid or mitochondria.

The sequence of b1223 (Accession number NP_415741) from Escherichia coli has been published in Blattner et al., Science 277 (5331), 1453-1474 (1997), and its activity is being defined as "nitrite extrusion protein". Accordingly, in one embodiment, the process of the present invention comprises the use of a "nitrite extrusion protein" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a b1223 protein is increased or generated, e.g. from Escherichia coli or a homolog thereof, preferably linked at least to one transit peptide as mentioned for example in table V.

In another embodiment, in the process of the present invention the activity of a b1223 protein is increased or generated in a subcellular compartment of the organism or organism cell such as in an organelle like a plastid or mitochondria.

The sequence of b1704 (Accession number NP_416219) from Escherichia coli has been published in Blattner et al., Science 277 (5331), 1453-1474 (1997), and its activity is being defined as "3-deoxy-D-arabinoheptulosonate-7-phosphate synthase (DAHP synthetase, tryptophan repressible)". Accordingly, in one embodiment, the process of the present invention comprises the use of a "3-deoxy-D-arabinoheptulosonate-7-phosphate synthase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a b1704 protein is increased or generated, e.g. from Escherichia coli or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b2066 (Accession number NP_416570) from Escherichia coli has been published in Blattner et al., Science 277 (5331), 1453-1474 (1997), and its activity is being defined as "uridine/cytidine kinase". Accordingly, in one embodiment, the process of the present invention comprises the use of a "uridine/cytidine kinase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a b2066 protein is increased or generated, e.g. from Escherichia coli or a homolog thereof, preferably linked at least to one transit peptide as mentioned for example in table V.

In another embodiment, in the process of the present invention the activity of a b2066 protein is increased or generated in a subcellular compartment of the organism or organism cell such as in an organelle like a plastid or mitochondria.

The sequence of b2965 (Accession number NP_417440) from Escherichia coli has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a b2965 protein is increased or generated, e.g. from Escherichia coli or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b3770 (Accession number YP_026247) from Escherichia coli has been published in Blattner et al., Science 277 (5331), 1453-1474 (1997), and its activity is being defined as "branched-chain amino-acid aminotransferase". Accordingly, in one embodiment, the process of the present invention comprises the use of a "branched-chain amino-acid aminotransferase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a b3770 protein is increased or generated, e.g. from *Escherichia coli* or a homolog thereof, preferably linked at least to one transit peptide as mentioned for example in table V.

In another embodiment, in the process of the present invention the activity of a b3770 protein is increased or generated in a subcellular compartment of the organism or organism cell such as in an organelle like a plastid or mitochondria.

The sequence of b3117 (Accession number PIR: DWECTD) from *Escherichia coli* has been published in Blattner et al., Science 277 (5331), 1453-1474 (1997), and its activity is being defined as "threonine dehydratase, catabolic, PLP-dependent". Accordingly, in one embodiment, the process of the present invention comprises the use of a "threonine dehydratase, catabolic, PLP-dependent" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a b3117 protein is increased or generated, e.g. from *Escherichia coli* or a homolog thereof, preferably linked at least to one transit peptide as mentioned for example in table V.

In another embodiment, in the process of the present invention the activity of a b3117 protein is increased or generated in a subcellular compartment of the organism or organism cell such as in an organelle like a plastid or mitochondria.

The sequence of YOR353C (Accession number NP_014998) from *Saccharomyces cerevisiae* has been published in Goffeau et al., Science 274 (5287), 546-547, 1996, and its activity is being defined as "Protein required for cell morphogenesis and cell separation after mitosis; Sog2p". Accordingly, in one embodiment, the process of the present invention comprises the use of a "Protein required for cell morphogenesis and cell separation after mitosis; Sog2p" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YOR353C protein is increased or generated, e.g. from *Saccharomyces cerevisiae* or a homolog thereof, preferably linked at least to one transit peptide as mentioned for example in table V.

In another embodiment, in the process of the present invention the activity of an YOR353C protein is increased or generated in a subcellular compartment of the organism or organism cell such as in an organelle like a plastid or mitochondria.

The sequence of YAL038W (Accession number NP_009362) from *Saccharomyces cerevisiae* has been published in Goffeau et al., Science 274 (5287), 546-547, 1996 and Bussey et al., Proc. Natl. Acad. Sci. U.S.A. 92 (9), 3809-3813 (1995), and its activity is being defined as "pyruvate kinase", which functions as a homotetramer in glycolysis to convert phosphoenolpyruvate to pyruvate (Cdc19p). Pyruvate is the input for aerobic (TCA cycle) or anaerobic (glucose fermentation) respiration. Accordingly, in one embodiment, the process of the present invention comprises the use of a "pyruvate kinase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YAL038W protein is increased or generated, e.g. from *Saccharomyces cerevisiae* or a homolog thereof, preferably linked at least to one transit peptide as mentioned for example in table V.

In another embodiment, in the process of the present invention the activity of an YAL038W protein is increased or generated in a subcellular compartment of the organism or organism cell such as in an organelle like a plastid or mitochondria.

The sequence of YDR497C (Accession number NP_010785) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "myo-inositol transporter". Accordingly, in one embodiment, the process of the present invention comprises the use of a "myo-inositol transporter" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YDR497C protein is increased or generated, e.g. from *Saccharomyces cerevisiae* or a homolog thereof, preferably linked at least to one transit peptide as mentioned for example in table V.

In another embodiment, in the process of the present invention the activity of an YDR497C protein is increased or generated in a subcellular compartment of the organism or organism cell such as in an organelle like a plastid or mitochondria.

The sequence of YEL046C (Accession number NP_010868) from *Saccharomyces cerevisiae* has been published in Goffeau et al., Science 274 (5287), 546-547, 1996 and Dietrich et al., Nature 387 (6632 Suppl), 78-81 (1997), and its activity is being defined as a "L-threonine aldolase", which catalyzes cleavage of L-allo-threonine and L-threonine to Glycine (Gly1p). Accordingly, in one embodiment, the process of the present invention comprises the use of a "L-threonine aldolase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YEL046C protein is increased or generated, e.g. from *Saccharomyces cerevisiae* or a homolog thereof, preferably linked at least to one transit peptide as mentioned for example in table V.

In another embodiment, in the process of the present invention the activity of an YEL046C protein is increased or generated in a subcellular compartment of the organism or organism cell such as in an organelle like a plastid or mitochondria.

The sequence of YER024W (Accession number NP_010941) from *Saccharomyces cerevisiae* has been published in Goffeau et al., Science 274 (5287), 546-547, 1996 and Dietrich et al., Nature 387 (6632 Suppl), 78-81 (1997) and its activity is being defined as a "carnitine acetyltransferase". Accordingly, in one embodiment, the process of the present invention comprises the use of a carnitine acetyltransferase or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YER024W protein is increased or generated, e.g. from *Saccharomyces cerevisiae* or a homolog thereof, preferably linked at least to one transit peptide as mentioned for example in table V.

In another embodiment, in the process of the present invention the activity of a YER024W protein is increased or generated in a subcellular compartment of the organism or organism cell such as in an organelle like a plastid or mitochondria.

The sequence of YKR043C (Accession number NP_012969) from *Saccharomyces cerevisiae* has been published in Goffeau et al., Science 274 (5287), 546-547, 1996 and Dujon et al., Nature 369 (6479), 371-378 (1994), and its activity is being defined as a "phosphoglycerate mutase like protein". Accordingly, in one embodiment, the process of the present invention comprises the use of a "phosphoglycerate mutase like protein" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YKR043C protein is increased or generated, e.g. from *Saccharomyces cerevisiae* or a homolog thereof, preferably linked at least to one transit peptide as mentioned for example in table V.

In another embodiment, in the process of the present invention the activity of an YKR043C protein is increased or generated in a subcellular compartment of the organism or organism cell such as in an organelle like a plastid or mitochondria.

The sequence of YLR174W (Accession number NP_013275) from *Saccharomyces cerevisiae* has been published in Goffeau et al., Science 274 (5287), 546-547, 1996 and Johnston et al., Nature 387 (6632 Suppl), 87-90 (1997), and its activity is being defined as a "NADP-dependent isocitrate dehydrogenase". Accordingly, in one embodiment, the process of the present invention comprises the use of a "NADP-dependent isocitrate dehydrogenase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YLR174W protein is increased or generated, e.g. from *Saccharomyces cerevisiae* or a homolog thereof, preferably linked at least to one transit peptide as mentioned for example in table V.

In another embodiment, in the process of the present invention the activity of an YLR174W protein is increased or generated in a subcellular compartment of the organism or organism cell such as in an organelle like a plastid or mitochondria.

The sequence of YNL241C (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of leucine, isoleucine and/or valine, in particular for increasing the amount of leucine, isoleucine and/or valine in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of an YNL241C protein is increased or generated in a subcellular compartment of the organism or organism cell such as in an organelle like a plastid or mitochondria.

In one embodiment, the homolog of the YOR353C, YAL038W, YDR497C, YEL046C, YER024W, YKR043C, YLR174W and/or YNL241C, is a homolog having said activity and being derived from Eukaryot. In one embodiment, the homolog of the b0342, b1223, b3117, b1704, b2066, b2965 and/or b3770 is a homolog having said activity and being derived from bacteria. In one embodiment, the homolog of the YOR353C, YAL038W, YDR497C, YEL046C, YER024W, YKR043C, YLR174W and/or YNL241C is a homolog having said activity and being derived from Fungi. In one embodiment, the homolog of the b0342, b1223, b3117, b1704, b2066, b2965 and/or b3770 is a homolog having said activity and being derived from Proteobacteria. In one embodiment, the homolog of the YOR353C, YAL038W, YDR497C, YEL046C, YER024W, YKR043C, YLR174W and/or YNL241C is a homolog having said activity and being derived from Ascomycota. In one embodiment, the homolog of the b0342, b1223, b3117, b1704, b2066, b2965 and/or b3770 is a homolog having said activity and being derived from Gammaproteobacteria. In one embodiment, the homolog of the YOR353C, YAL038W, YDR497C, YEL046C, YER024W, YKR043C, YLR174W and/or YNL241C is a homolog having said activity and being derived from *Saccharomycotina*.

In one embodiment, the homolog of the b0342, b1223, b3117, b1704, b2066, b2965 and/or b3770 is a homolog having said activity and being derived from Enterobacteriales. In one embodiment, the homolog of the YOR353C, YAL038W, YDR497C, YEL046C, YER024W, YKR043C, YLR174W and/or YNL241C is a homolog having said activity and being derived from *Saccharomycetes*. In one embodiment, the homolog of the b0342, b1223, b3117, b1704, b2066, b2965 and/or b3770 is a homolog having said activity and being derived from Enterobacteriaceae. In one embodiment, the homolog of the YOR353C, YAL038W, YDR497C, YEL046C, YER024W, YKR043C, YLR174W and/or YNL241C is a homolog having said activity and being derived from *Saccharomycetales*. In one embodiment, the homolog of the b0342, b1223, b3117, b1704, b2066, b2965 and/or b3770 is a homolog having said activity and being derived from *Escherichia*, preferably from *Escherichia coli*. In one embodiment, the homolog of the YOR353C, YAL038W, YDR497C, YEL046C, YER024W, YKR043C, YLR174W and/or YNL241C is a homolog having said activity and being derived from Saccharomycetaceae. In one embodiment, the homolog of the YOR353C, YAL038W, YDR497C, YEL046C, YER024W, YKR043C, YLR174W and/or YNL241C is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 4, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 4, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 4, column 3, or which has at least 10% of the original enzymatic activity, preferably 20%, particularly preferably 30%, most particularly preferably 40% in comparison to a protein as shown in table II, application no. 4, column 3 of *Saccharomyces cerevisiae*.

for the disclosure of the paragraphs [0040.0.0.3] to [0047.0.0.3] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 4, column 3 its biochemical or genetical causes and the increased amount of the fine chemical.

for the disclosure of the paragraphs [0049.0.0.3] to [0051.0.0.3] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 4, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.3] to [0058.0.0.3] see paragraphs [0053.0.0.0] to [0058.0.0.0] above.

In case the activity of the *Escherichia coli* protein b0342 or its homologs, e.g. a "thiogalactoside acetyltransferase" is increased advantageously in an organelle such as a plastid or mitochondria, preferably, in one embodiment an increase of the fine chemical, preferably of valine between 21% and 68% or more is conferred.

In case the activity of the *Escherichia coli* protein b1223 or its homologs, e.g. a "nitrite extrusion protein" is increased advantageously in an organelle such as a plastid or mitochondria, preferably, in one embodiment an increase of the fine chemical, preferably of valine between 30% and 157% or more is conferred.

In case the activity of the *Escherichia coli* protein b3117 or its homologs, e.g. a "threonine dehydratase, catabolic, PLP-dependent" is increased advantageously in an organelle such as a plastid or mitochondria, preferably, in one embodiment an increase of the fine chemical, preferably of leucine between 209% and 703% or more and/or isoleucine between 233% and 36031% or more is conferred.

In case the activity of the *Escherichia coli* protein b1704 or its homologs, e.g. a "3-deoxy-D-arabinoheptulosonate-7-phosphate synthase" is increased advantageously in an organelle such as a plastid or mitochondria, preferably, in one embodiment an increase of the fine chemical, preferably of leucine between 40% and 541% or more and/or valine between 24% and 287% or more is conferred.

In case the activity of the *Escherichia coli* protein b2066 or its homologs, e.g. a "uridine/cytidine kinase" is increased advantageously in an organelle such as a plastid or mitochondria, preferably, in one embodiment an increase of the fine chemical, preferably of isoleucine between 58% and 199% or more and/or valine between 30% and 99% or more is conferred.

In case the activity of the *Escherichia coli* protein b2965 or its homologs, e.g. an "ornithine decarboxylase" is increased advantageously in an organelle such as a plastid or mitochondria, preferably, in one embodiment an increase of the fine chemical, preferably of valine between 20% and 299% or more is conferred.

In case the activity of the *Escherichia coli* protein b3770 or its homologs, e.g. a "branched-chain amino-acid aminotransferase" is increased advantageously in an organelle such as a plastid or mitochondria, preferably, in one embodiment an increase of the fine chemical, preferably of valine between 53% and 128% or more is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably of leucine between 58% and 261% or more or isoleucine between 33% and 97% or more and/or valine between 21% and 206% or more is conferred.

In case the activity of the *Saccharomyces cerevisiae* protein YOR353C or its homologs, e.g. a "protein required for cell morphogenesis and cell separation after mitosis; Sog2p" is increased advantageously in an organelle such as a plastid or mitochondria, preferably, in one embodiment an increase of the fine chemical, preferably of leucine between 54% and 172% or more and/or isoleucine between 34% and 132% or more and/or valine between 20% and 77% or more is conferred.

In case the activity of the *Saccharomyces cerevisiae* protein YDR497C or its homologs, e.g. a "myo-inositol transporter" is increased advantageously in an organelle such as a plastid or mitochondria, preferably, in one embodiment an increase of the fine chemical, preferably of leucine between 46% and 87% and/or isoleucine between 34% and 43% or more is conferred.

In case the activity of the *Saccharomyces cerevisiae* protein YEL046C or its homologs, e.g. a "L-threonine aldolase" is increased advantageously in an organelle such as a plastid or mitochondria, preferably, in one embodiment an increase of the fine chemical, preferably of leucine between 117% and 144% or more is conferred.

In case the activity of the *Saccharomyces cerevisiae* protein YER024W or its homologs, e.g. a "carnitine acetyltransferase" is increased advantageously in an organelle such as a plastid or mitochondria, preferably, in one embodiment an increase of the fine chemical, preferably of leucine between 50% and 68% and/or isoleucine between 40% and 43% or more is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably, in one embodiment an increase of the fine chemical, preferably of valine between 20% and 260% or more is conferred.

In case the activity of the *Saccharomyces cerevisiae* protein YLR174W or its homologs, e.g. a "NADP-dependent isocitrate dehydrogenase" is increased advantageously in an organelle such as a plastid or mitochondria, preferably, in one embodiment an increase of the fine chemical, preferably of valine between 19% and 30% or more is conferred.

In case the activity of the *Saccharomyces cerevisiae* protein YNL241C or its homologs, e.g. an "glucose-6-phosphate dehydrogenase" is increased advantageously in an organelle such as a plastid or mitochondria, preferably, in one embodiment an increase of the fine chemical, preferably of valine between 57% and 88% and/or isoleucine between 30% and 33% or more is conferred.

In case the activity of the *Escherichia coli* protein b0342 or its homologs, e.g. a "thiogalactoside acetyltransferase" is increased advantageously in an organelle such as a plastid or mitochondria, preferably an increase of the fine chemical and of proteins containing valine is conferred.

In case the activity of the *Escherichia coli* protein b1223 or its homologs, e.g. a "nitrite extrusion protein" is increased advantageously in an organelle such as a plastid or mitochondria, preferably an increase of the fine chemical and of proteins containing valine is conferred.

In case the activity of the *Escherichia coli* protein b3117 or its homologs, e.g. a "threonine dehydratase, catabolic, PLP-dependent" is increased advantageously in an organelle such as a plastid or mitochondria, preferably an increase of the fine chemical and of proteins containing leucine and/or isoleucine is conferred.

In case the activity of the *Escherichia coli* protein b1704 or its homologs, e.g. a "3-deoxy-D-arabinoheptulosonate-7-phosphate synthase" is increased advantageously in an organelle such as a plastid or mitochondria, preferably an increase of the fine chemical and of proteins containing leucine and/or valine is conferred.

In case the activity of the *Escherichia coli* protein b2066 or its homologs, e.g. a "uridine/cytidine kinase" is increased advantageously in an organelle such as a plastid or mitochondria, preferably, in one embodiment an increase of the fine chemical, preferably an increase of the fine chemical and of proteins containing isoleucine and/or valine is conferred.

In case the activity of the *Escherichia coli* protein b2965 or its homologs, e.g. an "ornithine decarboxylase" is increased advantageously in an organelle such as a plastid or mitochondria, preferably, in one embodiment an increase of the fine chemical, preferably an increase of the fine chemical and of proteins containing valine is conferred.

In case the activity of the *Escherichia coli* protein b3770 or its homologs, e.g. a "branched-chain amino-acid aminotransferase" is increased advantageously in an organelle such as a plastid or mitochondria, preferably, in one embodiment an increase of the fine chemical, preferably an increase of the fine chemical and of proteins containing valine is conferred.

In case the activity of the *Saccharomyces cerevisiae* protein YOR353C or its homologs, e.g. a "protein required for cell morphogenesis and cell separation after mitosis; Sog2p" is increased advantageously in an organelle such as a plastid or mitochondria, preferably, in one embodiment an increase of the fine chemical, preferably an increase of the fine chemical and of proteins containing isoleucine, leucine and/or valine is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably an increase of the fine chemical and of proteins containing isoleucine, leucine and/or valine is conferred.

In case the activity of the *Saccharomyces cerevisiae* protein YDR497C or its homologs, e.g. a "myo-inositol transporter" is increased advantageously in an organelle such as a plastid or mitochondria, preferably, in one embodiment an increase of the fine chemical, preferably an increase of the fine chemical and of proteins containing leucine and/or isoleucine is conferred.

In case the activity of the *Saccharomyces cerevisiae* protein YEL046C or its homologs, e.g. a "L-threonine aldolase" is increased advantageously in an organelle such as a plastid or mitochondria, preferably, in one embodiment an increase of the fine chemical, preferably an increase of the fine chemical and of proteins containing leucine is conferred.

In case the activity of the *Saccharomyces cerevisiae* protein YER024W or its homologs, e.g. a "carnitine acetyltransferase" is increased advantageously in an organelle such as a plastid or mitochondria, preferably, in one embodiment an increase of the fine chemical, preferably an increase of the fine chemical and of proteins containing leucine and/or isleucine is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably, in one embodiment an increase of the fine chemical, preferably an increase of the fine chemical and of proteins containing valine is conferred.

In case the activity of the *Saccharomyces cerevisiae* protein YLR174W or its homologs, e.g. a "NADP-dependent isocitrate dehydrogenase" is increased advantageously in an organelle such as a plastid or mitochondria, preferably, in one embodiment an increase of the fine chemical, preferably an increase of the fine chemical and of proteins containing valine is conferred.

In case the activity of the *Saccharomyces cerevisiae* protein YNL241C or its homologs, e.g. an "glucose-6-phosphate dehydrogenase" is increased advantageously in an organelle such as a plastid or mitochondria, preferably, in one embodiment an increase of the fine chemical, preferably an increase of the fine chemical and of proteins containing isoleucine and/or valine is conferred.

for the disclosure of the paragraphs [0061.0.0.3] and [0062.0.0.3] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 4, column 7 or of the polypeptide as shown in the amino acid sequences as disclosed in table II, application no. 4, columns 5 and 7 or the functional homologues thereof as described herein, or is encoded by the nucleic acid molecule characterized herein or the nucleic acid molecule according to the invention, for example by the nucleic acid molecule as shown in table I, application no. 4, columns 5 and 7 or its herein described functional homologues and has the herein mentioned activity.

For the purposes of the present invention, the terms "L-leucine, L-isoleucine and/or L-valine" and "leucine, isoleucine and/or valine" also encompass the corresponding salts, such as, for example, leucine, isoleucine and/or valine hydrochloride or leucine, isoleucine and/or valine sulfate. Preferably the terms leucine, isoleucine and/or valine is intended to encompass the term L-leucine, L-isoleucine and/or L-valine.

for the disclosure of the paragraphs [0065.0.0.3] and [0066.0.0.3] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having a polypeptide having the activity of a protein as indicated in table II, application no. 4, columns 5 and 7 or its homologs activity having herein-mentioned leucine, isoleucine and/or valine increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 4, columns 5 and 7, e.g. a nucleic acid sequence encoding a polypeptide having a polypeptide having the activity of a protein as indicated in table II, application no. 4, columns 5 and 7 or its homologs activity or of a mRNA encoding the polypeptide of the present invention having herein-mentioned leucine, isoleucine and/or valine increasing activity; and/or c) increasing the specific activity of a protein conferring the increased expression of a protein encoded by the nucleic acid molecule of the invention or of the polypeptide of the present invention having herein-mentioned leucine, isoleucine and/or valine increasing activity, e.g. of a polypeptide having the activity of a protein as indicated in table II, application no. 4, columns 5 and 7 or its homologs activity, or decreasing the inhibitiory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned leucine, isoleucine and/or valine increasing activity, e.g. of a polypeptide having the activity of a protein as indicated in table II, application no. 4, columns 5 and 7 or its homologs activity; and/or e) stimulating activity of a protein conferring the increased expression of a protein encoded by the nucleic acid molecule of the present invention or a polypeptide of the present invention having herein-mentioned leucine, isoleucine and/or valine increasing activity, e.g. of a polypeptide having the activity of a protein as indicated in table II, application no. 4, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned leucine, isoleucine and/or valine increasing activity, e.g. of a polypeptide having the activity of a protein as indicated in table II, application no. 4, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned leucine, isoleucine and/or valine increasing activity, e.g. of a polypeptide having the activity of a protein as indicated in table II, application no. 4, columns 5 and 7 or its homologs activity; and/or h) increasing the expression of the endogenous gene encoding the polypeptide of the invention, e.g. a polypeptide having the activity of a protein as indicated in table II, application no. 4, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned leucine, isoleucine and/or valine increasing activity, e.g. of a polypeptide having the activity of a protein as indicated in table II, application no. 4, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned leucine, isoleucine and/or valine increasing activity, e.g. of a polypeptide having the activity of a protein as indicated in table II, application no. 4, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned leucine, isoleucine and/or valine increasing activity, e.g. of a polypeptide having the activity of a protein as indicated in table II, application no. 4, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 4, column 3 or its homologs. Preferably the increase of the fine chemical takes place in plastids.

for the disclosure of the paragraphs [0069.0.0.3] to [0079.0.0.3] see paragraphs [0069.0.0.0] to [0079.0.0.0] above.

The activation of an endogenous polypeptide having above-mentioned activity, e.g. having the activity of a protein as shown in table II, application no. 4, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 4, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 4, column 3. The expression of the chimeric transcription factor in a organism, in particular in a plant, leads to a specific expression of the protein as shown in table II, application no. 4, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.3] to [0084.0.0.3] see paragraphs [0081.0.0.0] to [0084.0.0.0] above.

Owing to the introduction of a gene or a plurality of genes conferring the expression of the nucleic acid molecule of the invention or the polypeptide of the invention, for example the nucleic acid construct mentioned below, or encoding the protein as shown in table II, application no. 4, column 3 into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutritional physiology limited) amino acids, like methionine, lysine or threonine alone or in combination in free or bound form.

for the disclosure of this paragraph see paragraph [0086.0.0.0] above.

By influencing the metabolism thus, it is possible to produce, in the process according to the invention, further advantageous compounds. Examples of such compounds are, in addition to leucine, isoleucine and/or valine for example compounds like amino acids such as methionine, threonine or lysine or other desirable compounds.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 4, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids;
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound amino acids, in particular leucine, isoleucine and/or valine.

for the disclosure of the paragraphs [0090.0.0.3] to [0097.0.0.3] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 4, columns 5 and 7 or a derivative thereof, or
b) a genetic regulatory element, for example a promoter, which is functionally linked to the nucleic acid sequence as shown table I, application no. 4, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 4, columns 5 and 7 joined to a nucleic acid sequence encoding a transit peptide, or a targeting nucleic acid sequence which directs the nucleic acid sequences disclosed in table I, application no. 4, columns 5 and 7 to the organelle preferentially the plastids. Altenatively the inventive nucleic acids sequences consist advantageously of the nucleic acid sequences as depicted in the sequence protocol and disclosed in table I, application no. 4, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine. After the activity of the protein as shown in table II, application no. 4, column 3 has been increased or generated in the cytsol or plastids, preferentially in the plastids, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.3] to [0110.0.0.3] see paragraphs [0102.0.0.0] to [0110.0.0.0] above.

In a preferred embodiment, the fine chemical (leucine, isoleucine and/or valine) is produced in accordance with the invention and, if desired, is isolated. The production of further amino acids such as lysine, methionine, threonine, tryptophane etc. and of amino acid mixtures by the process according to the invention is advantageous.

for the disclosure of the paragraphs [0112.0.0.3] to [0115.0.0.3] see paragraphs [0112.0.0.0] to [0115.0.0.0] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 4, columns 5 and 7 or a fragment thereof, which confers an increase in the amount of the fine chemical in an organism or a part thereof;
b) nucleic acid molecule comprising, preferably at least the mature form, of the nucleic acid molecule shown in table I, application no. 4, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybidizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 4, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 4, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 4, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 4, columns 5 and 7 by one or more nucleotides. In one embodiment, the nucleic acid molecule used in the process of the invention does not consist of the sequence indicated in table IA, application no. 4, columns 5 and 7. In one embodiment, the nucleic acid molecule used in the process of the invention is less than 100%, 99.999%, 99.99%, 99.9% or 99% identical to a sequence indicated in table IA, application no. 4, columns 5 and 7. In another embodiment, the nucleic acid molecule does not encode a polypeptide of a sequence indicated in table IIA, application no. 4, columns 5 and 7.

In one embodiment, the nucleic acid molecule used in the process of the invention distinguishes over the sequence indicated in table IB, application no. 4, columns 5 and 7, by one or more nucleotides. In one embodiment, the nucleic acid molecule used in the process of the invention does not consist of the sequence indicated in table IB, application no. 4, columns 5 and 7. In one embodiment, the nucleic acid molecule used in the process of the invention is less than 100%, 99.999%, 99.99%, 99.9% or 99% identical to a sequence indicated in table IB, application no. 4, columns 5 and 7. In another embodiment, the nucleic acid molecule does not encode a polypeptide of a sequence indicated in table IIB, application no. 4, columns 5 and 7.

In one embodiment, the nucleic acid molecule used in the process distinguishes over the sequence shown in table I, application no. 4, columns 5 and 7 by one or more nucleotides or does not consist of the sequence shown in table I, application no. 4, columns 5 and 7. In one embodiment, the nucleic acid molecule of the present invention is less than 100%, 99.999%, 99.99%, 99.9% or 99% identical to the sequence shown in table I, application no. 4, columns 5 and 7. In another embodiment, the nucleic acid molecule does not encode a polypeptide of the sequence shown in table II, application no. 4, columns 5 and 7.

for the disclosure of the paragraphs [0118.0.0.3] to [0120.0.0.3] see paragraphs [0118.0.0.0] to [0120.0.0.0] above.

Nucleic acid molecules with the sequence shown in table I, application no. 4, columns 5 and 7, nucleic acid molecules which are derived from the amino acid sequences shown in table II, application no. 4, columns 5 and 7 or from polypeptides comprising the consensus sequence shown in table IV, application no. 4, column 7, or their derivatives or homologues encoding polypeptides with the enzymatic or biological activity of a protein as shown in table II, application no. 4, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 4, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 4, column 3 and conferring the fine chemical increase by expression either in the cytsol or in an organelle such as a plastid or mitochondria or both, preferably in plastids.

for the disclosure of the paragraphs [0126.0.0.3] to [0133.0.0.3] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 4, columns 5 and 7 or the functional homologues thereof as described herein, preferably conferring above-mentioned activity, i.e. conferring the fine chemical increase after increasing its activity, e.g. after increasing the activity of a protein as shown in table II, column 3 by for example expression either in the cytsol or in an organelle such as a plastid or mitochondria or both, preferably in plastids.

for the disclosure of the paragraphs [0135.0.0.3] to [0140.0.0.3] see paragraphs [0135.0.0.0] to [0140.0.0.0] above.

Synthetic oligonucleotide primers for the amplification, e.g. as shown in table III, application no. 4, column 7, by means of polymerase chain reaction can be generated on the basis of a sequence shown herein, for example the sequence shown in table I, application no. 4, columns 5 and 7 or the sequences derived from table II, application no. 4, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 4, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 4, column 3 or further functional homologs of the polypeptide of the invention from other organisms.

for the disclosure of the paragraphs [0144.0.0.3] to [0151.0.0.3] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 4, columns 5 and 7, preferably shown in table IB, application no. 4, columns 5 and 7 under relaxed hybridization conditions and which code on expression for peptides having the methionine increasing activity.

for the disclosure of the paragraphs [0153.0.0.3] to
see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 4, columns 5 and 7, preferably shown in table IB, application no. 4, columns 5 and 7 is one which is sufficiently complementary to one of the nucleotide sequences shown in table I, application no. 4, columns 5 and 7, preferably shown in table IB, application no. 4, columns 5 and 7 such that it can hybridize to one of the nucleotide sequences shown in table I, application no. 4, columns 5 and 7, preferably shown in table IB, application no. 4, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 4, columns 5 and 7, preferably shown in table IB, application no. 4, columns 5 and 7, or a portion thereof and preferably has above mentioned activity, in particular having a fine chemical increasing activity after increasing the activity or an activity of a gene product as shown in table II, application no. 4, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 4, columns 5 and 7, preferably shown in table IB, application no. 4, columns 5 and 7, or a portion thereof and encodes a protein having above-mentioned activity, e.g. conferring of a leucine, isoleucine and/or valine increase by for example expression either in the cytsol or in an organelle such as a plastid or mitochondria or both, preferably in plastids, and optionally, the activity of a protein as shown in table II, application no. 4, column 3.

Moreover, the nucleic acid molecule of the invention can comprise only a portion of the coding region of one of the sequences shown in table I, application no. 4, columns 5 and 7, preferably shown in table IB, application no. 4, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 4, columns 5 and 7, preferably shown in table IB, application no. 4, columns 5 and 7, an anti-sense sequence of one of the sequences, e.g., set forth in table I, application no. 4, columns 5 and 7, preferably shown in table IB, application no. 4, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 4, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 4, columns 5 and 7 such that the protein or portion thereof maintains the ability to participate in the fine chemical production, in particular a leucine, isoleucine and/or valine increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 4, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 4, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.3] and [0169.0.0.3] see paragraphs [0168.0.0.0] to [0169.0.0.0] above.

The invention further relates to nucleic acid molecules that differ from one of the nucleotide sequences shown in table I, application no. 4, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 4, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 4, columns 5 and 7 or the functional homologues. In a still further embodiment, the nucleic acid molecule of the invention encodes a full length protein which is substantially homologous to an amino acid sequence shown in table II, application no. 4, columns 5 and 7 or the functional homologues. However, in a preferred embodiment, the nucleic acid molecule of the present invention does not consist of the sequence shown in table I, application no. 4, columns 5 and 7, preferably as indicated in table IA, application no. 4, columns 5 and 7. Preferably the nucleic acid molecule of the invention is a functional homologue or identical to a nucleic acid molecule indicated in table IB, application no. 4, columns 5 and 7.

for the disclosure of the paragraphs [0171.0.0.3] to [0173.0.0.3] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 4, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 4, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having abovementioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 4, columns 5 and 7.

for the disclosure of the paragraphs [0179.0.0.3] and [0180.0.0.3] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 4, columns 5 and 7, preferably shown in table IIA, application no. 4, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 4, columns 5 and 7, preferably shown in table IIA, application no. 4, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 4, columns 5 and 7, preferably shown in table IIA, application no. 4, columns 5 and 7, more preferably at least about 70% identical to one of the sequences shown in table II, application no. 4, columns 5 and 7, preferably shown in table IIA, application no. 4, columns 5 and 7, even more preferably at least about 80%, 90%, 95% homologous to the sequence shown in table II, application no. 4, columns 5 and 7, and most preferably at least about 96%, 97%, 98%, or 99% identical to the sequence shown in table II, application no. 4, columns 5 and 7, preferably shown in table IIA, application no. 4, columns 5 and 7.

for the disclosure of the paragraphs [0182.0.0.3] to [0188.0.0.3] see paragraphs [0182.0.0.0] to [0188.0.0.0] above.

Functional equivalents derived from one of the polypeptides as shown in table II, application no. 4, columns 5 and 7, preferably shown in table IIB, application no. 4, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 4, columns 5 and 7, preferably shown in table IIB, application no. 4, columns 5 and 7 resp., according to the invention and are distinguished by essentially the same properties as the polypeptide as shown in table II, application no. 4, columns 5 and 7, preferably shown in table IIB, application no. 1, columns 5 and 7.

Functional equivalents derived from the nucleic acid sequence as shown in table I, application no. 4, columns 5 and 7, preferably shown in table IB, application no. 4, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 4, columns 5 and 7, preferably shown in table IIB, application no. 4, columns 5 and 7 resp., according to the invention and encode polypeptides having essentially the same properties as the polypeptide as shown in table II, application no. 4, columns 5 and 7, preferably shown in table IIB, application no. 4, columns 5 and 7.

for the disclosure of this paragraph see paragraph [0191.0.0.0] above.

A nucleic acid molecule encoding an homologous to a protein sequence of table II, application no. 4, columns 5 and 7, preferably shown in table IIB, application no. 4, columns 5 and 7 resp., can be created by introducing one or more nucleotide substitutions, additions or deletions into a nucleotide sequence of the nucleic acid molecule of the present invention, in particular of table I, application no. 4, columns 5 and 7, preferably shown in table IB, application no. 4, columns 5 and 7 resp., such that one or more amino acid substitutions, additions or deletions are introduced into the encoded protein. Mutations can be introduced into the encoding sequences of table I, application no. 4, columns 5 and 7, preferably shown in table IB, application no. 4, columns 5 and 7 resp., by standard techniques, such as site-directed mutagenesis and PCR-mediated mutagenesis.

for the disclosure of the paragraphs [0193.0.0.3] to [0196.0.0.3] see paragraphs [0193.0.0.0] to [0196.0.0.0] above.

Homologues of the nucleic acid sequences used, with the sequence shown in table I, application no. 4, columns 5 and 7, preferably shown in table IB, application no. 4, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 4, columns 5 and 7, preferably shown in table IB, application no. 4, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 4, columns 5 and 7, preferably shown in table IB, application no. 4, columns 5 and 7. It is preferred that the nucleic acid molecule comprises as little as possible other nucleotides not shown in any one of table I, application no. 4, columns 5 and 7, preferably shown in table IB, application no. 4, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 4, columns 5 and 7, preferably shown in table IB, application no. 4, columns 5 and 7.

Also preferred is that the nucleic acid molecule used in the process of the invention encodes a polypeptide comprising the sequence shown in table II, application no. 4, columns 5 and 7, preferably shown in table IIB, application no. 4, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 4, columns 5 and 7, preferably shown in table IIB, application no. 4, columns 5 and 7.

In one embodiment, the nucleic acid molecule of the invention or used in the process encodes a polypeptide comprising the sequence shown in table II, application no. 4, columns 5 and 7, preferably shown in table IIB, application no. 4, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 4, columns 5 and 7, preferably shown in table IB, application no. 4, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 4, columns 5 and 7 expressed under identical conditions.

Homologues of table I, application no. 4, columns 5 and 7 or of the derived sequences of table II, application no. 4, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.3] to [0215.0.0.3] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 4, columns 5 and 7, preferably in Table IIB, application no. 4, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 4, columns 5 and 7, preferably in Table IB, application no. 4, columns 5 and 7, or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 4, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 4, columns 7 and conferring an increase in the amount of the fine chemical in an organism or a part thereof;

k) nucleic acid molecule encoding the amino acid sequence of a polypeptide encoding a domain of the polypeptide shown in table II, application no. 4, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 4, columns 5 and 7 or a nucleic acid molecule encoding, preferably at least the mature form of, the polypeptide shown in table II, application no. 4, columns 5 and 7, and conferring an increase in the amount of the fine chemical in an organism or a part thereof; or which encompasses a sequence which is complementary thereto; whereby, preferably, the nucleic acid molecule according to (a) to (l) distinguishes over the sequence depicted in table IA and/or IB, application no. 4, columns 5 and 7 by one or more nucleotides. In one embodiment, the nucleic acid molecule of the invention does not consist of the sequence shown in table IA and/or IB, application no. 4, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 4, columns 5 and 7. In a further embodiment the nucleic acid molecule does not encode the polypeptide sequence shown in table IIA and/or IIB, application no. 4, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 4, columns 5 and 7 does not encode a protein of the sequence shown in table IIA and/or IIB, application no. 4, columns 5 and 7. Accordingly, in one embodiment, the protein encoded by a sequence of a nucleic acid according to (a) to (l) does not consist of the sequence shown in table IA and/or IB, application no. 4, columns 5 and 7. In a further embodiment, the protein of the present invention is at least 30% identical to protein sequence depicted in table IIA and/or IIB, application no. 4, columns 5 and 7 and less than 100%, preferably less than 99.999%, 99.99% or 99.9%, more preferably less than 99%, 985, 97%, 96% or 95% identical to the sequence shown in table IIA and/or IIB, application no. 4, columns 5 and 7.

for the disclosure of the paragraphs [0217.0.0.3] to [0226.0.0.3] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in E. coli and in Agrobacterium. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 4, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.3] to [0239.0.0.3] see paragraphs [0228.0.0.0] to [0239.0.0.0] above.

In addition to the sequence mentioned in table I, application no. 4, columns 5 and 7 or its derivatives, it is advantageous additionally to express and/or mutate further genes in the organisms. Especially advantageously, additionally at least one further gene of the amino acid biosynthetic pathway such as for L-lysine, L-threonine and/or L-methionine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the nucleic acids sequences of the invention containing the sequences shown in table I, application no. 4, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.0.3] to [0264.0.0.3] see paragraphs [0241.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 4, columns 5 and 7 and described herein to achieve an expression in one of said compartments or extracellular.

for the disclosure of the paragraphs [0266.0.0.3] to [0287.0.0.3] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 4, columns 5 and 7 or their homologs is functionally linked to a plastidial targeting sequence. A further preferred embodiment of the invention relates to a vector in which a nucleic acid sequence encoding one of the polypeptides shown in table II, application no. 4, columns 5 and 7 or their homologs is functionally linked to a regulatory sequences which permit the expression in plastids.

for the disclosure of the paragraphs [0289.0.0.3] to [0296.0.0.3] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0342, anti-b1223, anti-b3117, anti-b1704, anti-b2066, anti-b2965, anti-b3770, anti-YOR353C, anti-YAL038W, anti-YDR497C, anti-YEL046C, anti-YER024, anti-YKR43C, anti-YLR174W and/or anti-YNL241C protein antibody or an antibody against polypeptides as shown in table II, application no. 4, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 4, columns 5 and 7 or as coded by the nucleic acid molecule shown in table I, application no. 4, columns 5 and 7 or functional homologues thereof.

In one advantageous embodiment, in the method of the present invention the activity of a polypeptide is increased comprising or consisting of the consensus sequence shown in table IV, application no. 4, columns 7 and in one another embodiment, the present invention relates to a polypeptide comprising or consisting of the consensus sequence shown in table IV, application no. 4, columns 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.3] to [0304.0.0.3] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 4, columns 5 and 7 by one or more amino acids. In one embodiment, polypeptide distinguishes form the sequence shown in table II, application no. 4, columns 5 and 7 by more than 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from the sequence shown in table IIA and/or IIB, application no. 4, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 4, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 4, columns 5 and 7 by one or more amino acids. In another embodiment, said polypeptide of the invention does not consist of the sequence shown in table IIA and/or IIB, application no. 4, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 4, columns 5 and 7.

In one embodiment, the present invention relates to a polypeptide having the activity of the protein as shown in table IIA and/or IIB, application no. 4, column 3, which distinguishes over the sequence depicted in table IIA and/or IIB, application no. 4, columns 5 and 7 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.3] to [0311.0.0.3] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table IIA and/or IIB, application no. 4, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 4, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 4, columns 5 and 7 or which is homologous thereto, as defined above.

Accordingly the polypeptide of the present invention can vary from the sequences shown in table IIA and/or IIB, application no. 4, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 4, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 4, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 4, column 3. Differences shall mean at least one amino acid different from the sequences as shown in table II, application no. 4, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 4, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 4, column 3. The nucleic acid molecules and polypeptide molecules of the invention are expressed such that the yield, production, and/or efficiency of production of a desired compound is improved.

for the disclosure of the paragraphs [0320.0.0.3] to [0322.0.0.3] see paragraphs [0320.0.0.0] to [0322.0.0.0] above.

In one embodiment, a protein (=polypeptide) as shown in table II, application no. 4, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 4, column 3, e.g., a protein which does not confer the activity described herein and which is derived from the same or a different organism.

for the disclosure of the paragraphs [0324.0.0.3] to [0329.0.0.3] see paragraphs [0324.0.0.0] to [0329.0.0.0] above.

In an especially preferred embodiment, the polypeptide according to the invention furthermore also does not have the sequences of those proteins which are encoded by the sequences shown in table II, application no. 4, columns 5 and 7.

for the disclosure of the paragraphs [0331.0.0.3] to [0346.0.0.3] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 4, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 4, column 3 or a protein as shown in table II, application no. 4, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 4, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.3] to [0369.0.0.3] see paragraphs [0350.0.0.0] to [0369.0.0.0] above.

The fermentation broths obtained in this way, containing in particular L-valine, L-leucine and/or L-isoleucine preferably L-leucine and/or L-valine, normally have a dry matter content of from 7.5 to 25% by weight. The fermentation broth can be processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

for the disclosure of the paragraphs [0371.0.0.3] to [0376.0.0.3], [0376.1.0.3] and [0377.0.0.3] see paragraphs [371.0.0.0] to [0376.0.0.0], [376.1.0.0] and [0377.0.0.0] above.

In one embodiment, the present invention relates to a method for the identification of a gene product conferring an increase in the fine chemical production in a cell, comprising the following steps:

(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 4, columns 5 and 7, preferably in table IB, application no. 4, columns 5 and 7, and, optionally, isolating the full length cDNA clone or complete genomic clone;

(c) introducing the candidate nucleic acid molecules in host cells, preferably in a plant cell or a microorganism, appropriate for producing the fine chemical;

(d) expressing the identified nucleic acid molecules in the host cells;

(e) assaying the fine chemical level in the host cells; and (f) identifying the nucleic acid molecule and its gene product which expression confers an increase in the fine chemical level in the host cell after expression compared to the wild type.

for the disclosure of the paragraphs [0379.0.0.3] to [0383.0.0.3] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 4, column 3, e.g. comparing near identical organisms with low and high activity of the proteins as shown in table II, application no. 4, column 3.

for the disclosure of the paragraphs [0385.0.0.3] to [0435.0.0.3] see paragraphs [0385.0.0.0] to [0435.0.0.0] above.

Leucine, isoleucine and/or valine production in *Chlamydomonas reinhardtii*

The amino acid production can be analysed as mentioned above. The proteins and nucleic acids can be analysed as mentioned below.

for the disclosure of the paragraphs [0437.0.0.3] to [0497.0.0.3] see paragraphs [0437.0.0.0] to [0497.0.0.0] above.

The results of the different plant analyses can be seen from the table, which follows:

TABLE VI

| ORF | Metabolite | Method | Min | Max |
|---|---|---|---|---|
| YOR353C | Leucine | GC | 1.54 | 2.72 |
| YOR353C | Isoleucine | GC | 1.34 | 2.32 |
| YOR353C | Valine | GC | 1.20 | 1.77 |
| YAL038W | Valine | GC | 1.21 | 3.06 |
| YAL038W | Isoleucine | GC | 1.33 | 1.97 |
| YAL038W | Leucine | GC | 1.58 | 3.61 |
| YDR497C | Isoleucine | GC | 1.34 | 1.43 |
| YDR497C | Leucine | GC | 1.46 | 1.87 |
| YEL046C | Leucine | GC | 2.17 | 2.44 |
| YER024W | Isoleucine | GC | 1.40 | 1.43 |
| YER024W | Leucine | GC | 1.50 | 1.68 |
| YKR043C | Valine | GC | 1.20 | 3.60 |
| YLR174W | Valine | GC | 1.19 | 1.30 |
| YNL241C | Valine | GC | 1.57 | 1.88 |
| YNL241C | Isoleucine | GC | 1.30 | 1.33 |
| b2066 | Valine | GC | 1.30 | 1.99 |
| b2066 | Isoleucine | GC | 1.58 | 2.99 |
| b1704 | Leucine | GC | 1.40 | 6.41 |
| b1704 | Valine | GC | 1.24 | 3.87 |
| b2965 | Valine | GC | 1.20 | 3.99 |
| b3770 | Valine | GC | 1.53 | 2.28 |
| b0342 | Valine | GC | 1.21 | 1.68 |
| b1223 | Valine | GC | 1.30 | 2.57 |

TABLE VI-continued

| ORF | Metabolite | Method | Min | Max |
|---|---|---|---|---|
| b3117 | Isoleucine | GC | 3.33 | 361.31 |
| b3117 | Leucine | GC | 3.09 | 8.03 | for the disclosure of the paragraphs [0499.0.0.3] and [0500.0.0.3] see paragraphs [0499.0.0.0] and [0500.0.0.0] above.

Example 15a

Engineering Ryegrass Plants by Over-Expressing YER024W from *Saccharomyces cerevisiae* or Homologs of YER024W from Other Organisms for the disclosure of the paragraphs [0502.0.0.3] to [0508.0.0.3] see paragraphs [0502.0.0.0] to [0508.0.0.0] above.

Example 15b

Engineering Soybean Plants by Over-expressing YER024W from *Saccharomyces cerevisiae* or Homologs of YER024W from Other Organisms for the disclosure of the paragraphs [0510.0.0.3] to [0513.0.0.3] see paragraphs [0510.0.0.0] to [0513.0.0.0] above.

Example 15c

Engineering Corn Plants by Over-Expressing YER024W from *Saccharomyces cerevisiae* or Homologs of YER024W from Other Organisms for the disclosure of the paragraphs [0515.0.0.3] to [0540.0.0.3] see paragraphs [0515.0.0.0] to [0540.0.0.0] above.

Example 15d

Engineering Wheat Plants by Over-Expressing YER024W from *Saccharomyces cerevisiae* or Homologs of YER024W from Other Organisms for the disclosure of the paragraphs [0542.0.0.3] to [0544.0.0.3] see paragraphs [0542.0.0.0] to [0544.0.0.0] above.

Example 15e

Engineering Rapeseed/Canola Plants by Over-Expressing YER024W from *Saccharomyces cerevisiae* or Homologs of YER024W from Other Organisms for the disclosure of the paragraphs [0546.0.0.3] to [0549.0.0.3] see paragraphs [0544.0.0.0] to [0549.0.0.0] above.

Example 15f

Engineering Alfalfa Plants by Over-Expressing YER024W from *Saccharomyces cerevisiae* or Homologs of YER024W from Other Organisms for the disclosure of the paragraphs [0551.0.0.3] to [0554.0.0.3] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants.

The results are shown in table VII

TABLE VII

| ORF_NAME | Metabolite | MIN | MAX |
|---|---|---|---|
| b1704 | Valine | 1.58 | 2.21 |
| b1704 | Leucine | 1.49 | 2.23 |
| YAL038W | Valine | 1.36 | 1.74 |
| YAL038W | Isoleucine | 1.49 | 7.52 |
| YDR497C | Isoleucine | 1.27 | 1.91 |
| YDR497C | Leucine | 1.79 | 2.12 |
| YEL046C | Leucine | 1.32 | 1.75 |
| YKR043C | Valine | 2.79 | 9.34 |
| YNL241C | Isoleucine | 1.35 | 1.74 |

Table VII shows the increase in valine, leucine, or isoleucine in genetically modified corn plants expressing the *Escherichia coli* nucleic acid sequence b1704 or the *Saccharomyces cerevisiae* nucleic acid sequences YAL038W, YDR497C, YEL046C, YKR043C and YNL241C.

In one embodiment, in case the activity of the *Escherichia coli* protein b1704 or its homologs, e.g. a "3-deoxy-D-arabinoheptulosonate-7-phosphate synthase (DAHP synthetase, tryptophan repressible)", is increased in corn plants, preferably, an increase of the fine chemical valine between 58% and 121% or more is conferred.

In one embodiment, in case the activity of the *Escherichia coli* protein b1704 or its homologs, e.g. a "3-deoxy-D-arabinoheptulosonate-7-phosphate synthase (DAHP synthetase, tryptophan repressible)", is increased in corn plants, preferably, an increase of the fine chemical leucine between 49% and 123% is conferred.

In one embodiment, in case the activity of the *Escherichia coli* protein b1704 or its homologs, e.g. a "3-deoxy-D-arabinoheptulosonate-7-phosphate synthase (DAHP synthetase, tryptophan repressible)", is increased in corn plants, preferably, an increase of the fine chemical leucine between 49% and 123% or more and of the fine chemical valine between 58% and 121% or more is conferred.

In one embodiment, in case the activity of the *Saccharomyces cerevisiae* protein YAL038W or its homologs, e.g. a "pyruvate kinase", is increased in corn plants, preferably, an increase of the fine chemical valine between 36% and 74% or more is conferred.

In one embodiment, in case the activity of the *Saccharomyces cerevisiae* protein YAL038W or its homologs, e.g. a "pyruvate kinase", is increased in corn plants, preferably, an increase of the fine chemical isoleucine between 49% and 652 or more % is conferred.

In one embodiment, in case the activity of the *Saccharomyces cerevisiae* protein YAL038W or its homologs, e.g. a "pyruvate kinase", is increased in corn plants, preferably, an increase of the fine chemical isoleucine between 49% and 652% and of the fine chemical valine between 36% and 74% or more is conferred.

In one embodiment, in case the activity of the *Saccharomyces cerevisiae* protein YDR497C or its homologs, e.g. a "myo-inositol transporter", is increased in corn plants, preferably, an increase of the fine chemical isoleucine between 27% and 91% or more is conferred.

In one embodiment, in case the activity of the *Saccharomyces cerevisiae* protein YDR497C or its homologs, e.g. a "myo-inositol transporter", is increased in corn plants, preferably, an increase of the fine chemical leucine between 79% and 121% or more is conferred.

In one embodiment, in case the activity of the *Saccharomyces cerevisiae* protein YDR497C or its homologs, e.g. a "myo-inositol transporter", is increased in corn plants, preferably, an increase of the fine chemical leucine between 79% and 121% or more and of the fine chemical isoleucine between 27% and 91% or more is conferred.

In one embodiment, in case the activity of the *Saccharomyces cerevisiae* protein YEL046C or its homologs, e.g. a "L-threonine aldolase", is increased in corn plants, preferably, an increase of the fine chemical leucine between 32% and 75% or more is conferred.

In one embodiment, in case the activity of the *Saccharomyces cerevisiae* protein YKR043C or its homologs, e.g. a "unknown ORF", is increased in corn plants, preferably, an increase of the fine chemical valine between 179% and 834% or more is conferred.

In one embodiment, in case the activity of the *Saccharomyces cerevisiae* protein YNL241C or its homologs, e.g. a "glucose-6-phosphate dehydrogenase", is increased in corn plants, preferably, an increase of the fine chemical isoleucine between 35% and 74% or more is conferred.

for the disclosure of this paragraph see [0554.2.0.0] above.

for the disclosure of this paragraph see [0555.0.0.0] above.

for the disclosure of the paragraphs [0001.0.0.4] to [0007.0.0.4] see paragraphs [0001.0.0.0] to [0007.0.0.0] above.

for the disclosure of the paragraphs [0007.1.0.4] and [0008.0.0.4] see paragraphs [0007.1.0.0] and [0008.0.0.0] above.

As described above, the essential amino acids are necessary for humans and many mammals, for example for livestock. Arginine is a semi-essential amino acid involved in multiple areas of human physiology and metabolism. It is not considered essential because humans can synthesize it de novo from glutamine, glutamate, and proline. However, dietary intake remains the primary determinant of plasma arginine levels, since the rate of arginine biosynthesis does not increase to compensate for depletion or inadequate supply. Dietary arginine intake regulates whole body arginine synthesis from proline in the neonatal piglet. The maximal rate of arginine synthesis (0.68 g/kg/d) is not enough to supply the whole body metabolic requirement for arginine in the young pig. In animals, glutamate functions as a neurotransmitter and activates glutamate receptor cation channels (iGluRs), which trigger electrical or $Ca^{2+}$ signal cascades. In plants, amino acids are involved in signalling of both plant nitrogen status and plant nitrogen:carbon ratios. Endogenous glutamine has been implicated in feedback inhibition of root N uptake, via the suppression of transcription of genes encoding inorganic nitrogen transporters (Rawat et al., Plant Journal 19: 143-152, 1999; Zhuo et al., Plant Journal 17: 563-568, 1999). The nonessential amino acid, proline, is synthesized from L-ornithine or L-glutamate. The proline from L-ornithine is linked to protein metabolism in the urea cycle and the proline from L-glutamate is linked to carbohydrate metabolism. Collagen is the major reservoir for proline in the body. Vitamin C should be used with proline for collagen problems.

for the disclosure of the paragraphs [0010.0.0.4] and [0011.0.0.4] see paragraphs [0010.0.0.0] and [0011.0.0.0] above.

It is an object of the present invention to develop an inexpensive process for the synthesis of arginine and/or glutamate and/or glutamine and/or proline, preferably L-arginine and/or L-glutamate and/or L-glutamine and/or L-proline.

for the disclosure of this paragraph see [0013.0.0.0] above.

Accordingly, in a first embodiment, the invention relates to a process for the production of a fine chemical, whereby the fine chemical is arginine, glutamate, glutamine and/or proline, preferably arginine, glutamate, glutamine and/or proline. Accordingly, in the present invention, the term "the fine chemical" as used herein relates to "arginine, glutamate, glutamine and/or proline". Further, the term "the fine chemicals" as used herein also relates to fine chemicals comprising arginine, glutamate, glutamine and/or proline.

In one embodiment, the term "the fine chemical" means arginine, glutamate, glutamine and/or proline. Throughout the specification the term "the fine chemical" means arginine, glutamate, glutamine and/or proline, preferably L-arginine, L-glutamate, L-glutamine and/or L-proline, its salts, ester or amids in free form or bound to proteins. In a preferred embodiment, the term "the fine chemical" means arginine, glutamate, glutamine and/or proline, preferably L-arginine, L-glutamate, L-glutamine and/or L-proline in free form or its salts or bound to proteins.

Accordingly, the present invention relates to a process for the production of arginine, glutamate, glutamine and/or proline, which comprises
(a) increasing or generating the activity of a protein as shown in table II, application no. 5, column 3 encoded by the nucleic acid sequences as shown in table I, application no. 5, column 5, in an organelle of a microorganism or plant, or
(b) increasing or generating the activity of a protein as shown in table II, application no. 5, column 3 encoded by the nucleic acid sequences as shown in table I, application no. 5, column 5 in the plastid of a microorganism or plant, or in one or more parts thereof; and
(b) growing the organism under conditions which permit the production of the fine chemical, thus, arginine, glutamate, glutamine and/or proline or fine chemicals comprising arginine, glutamate, glutamine and/or proline, in said organism or in the culture medium surrounding the organism.

Accordingly, the term "the fine chemical" means in one embodiment "arginine" in relation to all sequences listed in Table I to IV, application no. 5, lines 38, 40, 46 and 52 or homologs thereof and means in one embodiment "glutamate" in relation to all sequences listed in Tables I to IV, application no. 5, line 44 or homologs thereof and means in one embodiment "proline" in relation to all sequences listed in Table I to IV, application no. 5, lines 37, 39, 41, 42, 44, 45, 47 to 51 or homologs thereof and means in one embodiment "glutamine." in relation to all sequences listed in Tables I to IV, application no. 5, lines 36 and 43 or homologs thereof.

Accordingly, in one embodiment the term "the fine chemical" means "glutamate" and "proline" in relation to all sequences listed in Table I to IV, application no. 5, lines 37, 39, 41, 42, 44, 45, 47 to 51, in one embodiment the term "the fine chemical" means "arginine" and "glutamine" in relation to all sequences listed in Table I to IV, application no. 5, lines 36, 38, 40, 43, 46 and 52, in one embodiment the term "the fine chemical" means "glutamine" and "proline" in relation to all sequences listed in Table I to IV, application no. 5, lines 36, 37, 39, 41 to 45 and 47 to 51, in one embodiment the term "the fine chemical" means "arginine" and "glutamine" in relation to all sequences listed in Table I to IV, application no. 5, lines 36, 38, 40, 43, 46 and 52, in one embodiment the term "the fine chemical" means "arginine", "proline" and "glutamine" or "arginine", "proline", glutamate and "glutamine" in relation to all sequences listed in Table I to IV, application no. 5, lines 36 to 52.

Accordingly, the term "the fine chemical" can mean "arginine" and/or "glutamate" and/or "glutamine" and/or "proline", owing to circumstances and the context. In order to illustrate that the meaning of the term "the fine chemical" means "arginine", and/or "glutamate" and/or "glutamine" and/or "proline" the term "the respective fine chemical" is also used.

In another embodiment the present invention is related to a process for the production of arginine, glutamate, glutamine and/or proline, which comprises
(a) increasing or generating the activity of a protein as shown in table II, application no. 5, column 3 encoded by the nucleic acid sequences as shown in table I, application no. 5, column 5, in an organelle of a non-human organism, or
(b) increasing or generating the activity of a protein as shown in table II, application no. 5, column 3 encoded by the nucleic acid sequences as shown in table I, application no. 5, column 5, which are joined to a nucleic acid sequence encoding a transit peptide in a non-human organism, or in one or more parts thereof; or
(c) increasing or generating the activity of a protein as shown in table II, application no. 5, column 3 encoded by the nucleic acid sequences as shown in table I, application no. 5, column 5, which are joined to a nucleic acid sequence encoding chloroplast localization sequence, in a non-human organism, or in one or more parts thereof, and
(d) growing the organism under conditions which permit the production of arginine, glutamate, glutamine and/or proline in said organism.

In another embodiment, the present invention relates to a process for the production of arginine, glutamate, glutamine and/or proline, which comprises
(a) increasing or generating the activity of a protein as shown in table II, application no. 5, column 3 encoded by the nucleic acid sequences as shown in table I, application no. 5, column 5, in an organelle of a microorganism or plant through the transformation of the organelle, or
(b) increasing or generating the activity of a protein as shown in table II, application no. 5, column 3 encoded by the nucleic acid sequences as shown in table I, application no. 5, column 5 in the plastid of a microorganism or plant, or in one or more parts thereof through the transformation of the plastids; and
(c) growing the organism under conditions which permit the production of the fine chemical, thus, arginine, glutamate, glutamine and/or proline or fine chemicals comprising arginine, glutamate, glutamine and/or proline, in said organism or in the culture medium surrounding the organism.

Advantageously the activity of the protein as shown in table II, application no. 5, column 3 encoded by the nucleic acid sequences as shown in table I, application no. 5, column 5 is increased or generated in the abovementioned process in the plastid of a microorganism or plant.

for the disclosure of the paragraphs [0019.0.0.4] to [0024.0.0.4] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 5, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 5, column 3 and its homologs as disclosed in table I, application no. 5, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 5, column 3 and its homologs as disclosed in table I, application no. 5, columns 5 and 7.

for the disclosure of the paragraphs [0027.0.0.4] to [0029.0.0.4] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 5, columns 5 and 7. The person skilled in the art is able to join said sequences in a functional manner. Advantageously the transit peptide part is cleaved off from the protein part shown in table II, application no. 5, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 5, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 5, columns 5 and 7. In case of the amino acid sequence QIA CSS the three amino acids in front of the start methionine are stemming from the LIC (=ligation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 5, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 5, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 5, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.4] and [0030.3.0.4] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 5, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 5, columns 5 and 7 or a sequence encoding a protein, as depicted in table II, application no. 5, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 5, columns 5 and 7 or a sequence encoding a protein, as depicted in table II, application no. 5, columns 5 and 7 in such a manner that the viroid sequence transports a sequence transcribed from a sequence as depicted in table I, application no. 5 columns 5 and 7 or a sequence encoding a protein as depicted in table II, application no. 5 columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 5, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 5, columns 5 and 7.

In a preferred embodiment of the invention the nucleic acid sequences as shown in table I, application no. 5, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 5, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.4] and [0032.0.0.4] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 5, column 3. Preferably the modification of the activity of a protein as shown in table II, application no. 5, column 3 or their combination can be achieved by joining the protein to a transit peptide.

Surprisingly it was found, that the transgenic expression of the *Saccaromyces cerevisiae* protein as shown in table II, application no. 5, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b0342 (Accession number PIR:XX-ECTG) from *Escherichia coli* has been published in Blattner et al., Science 277 (5331), 1453-1474 (1997), and its activity is being defined as "thiogalactoside acetyltransferase". Accordingly, in one embodiment, the process of the present invention comprises the use of a "thiogalactoside acetyltransferase" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably glutamate and/or glutamine in free or bound form in an organism or a part thereof, as mentioned. In one embodiment, in the process of the present invention the activity of a b0342 protein is increased or generated, e.g. from *Escherichia coli* or a homolog thereof, preferably linked at least to one transit peptide as mentioned for example in table V.

In another embodiment, in the process of the present invention the activity of a b0342 protein is increased or generated in a subcellular compartment of the organism or organism cell such as in an organelle like a plastid or mitochondria.

The sequence of b0855 (Accession number NP_415376) from *Escherichia coli* has been published in Blattner et al., Science 277 (5331), 1453-1474 (1997), and its activity is being defined as "ATP-binding component of putrescine transport system". Accordingly, in one embodiment, the process of the present invention comprises the use of a "ATP-binding component of putrescine transport system" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably arginine in free or bound form in an organism or a part thereof, as mentioned. In one embodiment, in the process of the present invention the activity of a b0855 protein is increased or generated, e.g. from *Escherichia coli* or a homolog thereof, preferably linked at least to one transit peptide as mentioned for example in table V.

In another embodiment, in the process of the present invention the activity of a b0855 protein is increased or generated in a subcellular compartment of the organism or organism cell such as in an organelle like a plastid or mitochondria.

The sequence of b1062 (Accession number DEECOO) from *Escherichia coli* has been published in Blattner et al., Science 277 (5331), 1453-1474 (1997), and its activity is being defined as "dihydro-orotase". Accordingly, in one embodiment, the process of the present invention comprises the use of a "dihydro-orotase" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably proline in free or bound form in an organism or a part thereof, as mentioned. In one embodiment, in the process of the present invention the activity of a b1062 protein is increased or generated, e.g. from *Escherichia coli* or a homolog thereof, preferably linked at least to one transit peptide as mentioned for example in table V.

In another embodiment, in the process of the present invention the activity of a b1062 protein is increased or generated in a subcellular compartment of the organism or organism cell such as in an organelle like a plastid or mitochondria.

The sequence of b1184 (Accession number NP_415702) from *Escherichia coli* has been published in Blattner et al., Science 277 (5331), 1453-1474 (1997), and its activity is being defined as "SOS mutagenesis and repair". Accordingly, in one embodiment, the process of the present invention comprises the use of a "SOS mutagenesis and repair" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably proline in free or bound form in an organism or a part thereof, as mentioned. In one embodiment, in the process of the present invention the activity of a b1184 protein is increased or generated, e.g. from *Escherichia coli* or a homolog thereof, preferably linked at least to one transit peptide as mentioned for example in table V.

In another embodiment, in the process of the present invention the activity of a b1184 protein is increased or generated in a subcellular compartment of the organism or organism cell such as in an organelle like a plastid or mitochondria.

The sequence of b1223 (Accession number NP_415741) from *Escherichia coli* has been published in Blattner et al., Science 277 (5331), 1453-1474 (1997), and its activity is being defined as "nitrite extrusion protein". Accordingly, in one embodiment, the process of the present invention comprises the use of a "nitrite extrusion protein" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably proline in free or bound form in an organism or a part thereof, as mentioned. In one embodiment, in the process of the present invention the activity of a b1223 protein is increased or generated, e.g. from *Escherichia coli* or a homolog thereof, preferably linked at least to one transit peptide as mentioned for example in table V.

In another embodiment, in the process of the present invention the activity of a b1223 protein is increased or generated in a subcellular compartment of the organism or organism cell such as in an organelle like a plastid or mitochondria.

The sequence of b1264 (Accession number NP_415780) from *Escherichia coli* has been published in Blattner et al., Science 277 (5331), 1453-1474 (1997), and its activity is being defined as "anthranilate synthase component I". Accordingly, in one embodiment, the process of the present invention comprises the use of a "anthranilate synthase component I" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a b1264 protein is increased or generated, e.g. from *Escherichia coli* or a homolog thereof, preferably linked at least to one transit peptide as mentioned for example in table V.

In another embodiment, in the process of the present invention the activity of a b1264 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably proline in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1758 (Accession number NP_416272) from *Escherichia coli* has been published in Blattner et al., Science 277 (5331), 1453-1474 (1997), and its activity is being defined as "putative cytochrome oxidase". Accordingly, in one embodiment, the process of the present invention comprises the use of a "putative cytochrome oxidase" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably glutamate in free or bound form in an organism or a part thereof, as mentioned.

In one embodiment, in the process of the present invention the activity of a b1758 protein is increased or generated, e.g. from *Escherichia coli* or a homolog thereof, preferably linked at least to one transit peptide as mentioned for example in table V. In another embodiment, in the process of the present invention the activity of a b1758 protein is increased or generated in a subcellular compartment of the organism or organism cell such as in an organelle like a plastid or mitochondria.

The sequence of b1852 (Accession number NP_416366) from *Escherichia coli* has been published in Blattner et al., Science 277 (5331), 1453-1474 (1997), and its activity is being defined as "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a b1852 protein is increased or generated, e.g. from *Escherichia coli* or a homolog thereof, preferably linked at least to one transit peptide as mentioned for example in table V.

In another embodiment, in the process of the present invention the activity of a b1852 protein is increased or generated in a subcellular compartment of the organism or organism cell such as in an organelle like a plastid or mitochondria.

The sequence of b1907 (Accession number NP_416420) from *Escherichia coli* has been published in Blattner et al., Science 277 (5331), 1453-1474 (1997), and its activity is being defined as "tyrosine-specific transport protein" (HAAAP family). Accordingly, in one embodiment, the process of the present invention comprises the use of a "tyrosine-specific transport protein" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a b1907 protein is increased or generated, e.g. from *Escherichia coli* or a homolog thereof, preferably linked at least to one transit peptide as mentioned for example in table V.

In another embodiment, in the process of the present invention the activity of a b1907 protein is increased or generated in a subcellular compartment of the organism or organism cell such as in an organelle like a plastid or mitochondria.

The sequence of b2025 (Accession number NP_416529) from *Escherichia coli* has been published in Blattner et al., Science 277 (5331), 1453-1474 (1997), and its activity is being defined as "imidazole glycerol phosphate synthase subunit", which is in a heterodimer with HisH=imidazole glycerol phosphate synthase holoenzyme. Accordingly, in one embodiment, the process of the present invention comprises the use of a "imidazole glycerol phosphate synthase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a b2025 protein is increased or generated, e.g. from *Escherichia coli* or a homolog thereof, preferably linked at least to one transit peptide as mentioned for example in table V.

In another embodiment, in the process of the present invention the activity of a b2025 protein is increased or generated in a subcellular compartment of the organism or organism cell such as in an organelle like a plastid or mitochondria.

The sequence of b2040 (Accession number G64969) from *Escherichia coli* has been published in Blattner et al., Science 277 (5331), 1453-1474 (1997), and its activity is being defined as "TDP-rhamnose synthetase, NAD(P)-binding". Accordingly, in one embodiment, the process of the present invention comprises the use of a "TDP-rhamnose synthetase, NAD(P)-binding" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably glutamine in free or bound form in an organism or a part thereof, as mentioned. In one embodiment, in the process of the present invention the activity of a b2040 protein is increased or generated, e.g. from *Escherichia coli* or a homolog thereof, preferably linked at least to one transit peptide as mentioned for example in table V.

In another embodiment, in the process of the present invention the activity of a b2040 protein is increased or generated in a subcellular compartment of the organism or organism cell such as in an organelle like a plastid or mitochondria.

The sequence of b2818 (Accession number NP_417295) from *Escherichia coli* has been published in Blattner et al., Science 277 (5331), 1453-1474 (1997), and its activity is being defined as "N-acetylglutamate synthase (amino acid N-acetyltransferase)". Accordingly, in one embodiment, the process of the present invention comprises the use of a "N-acetylglutamate synthase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a b2818 protein is increased or generated, e.g. from *Escherichia coli* or a homolog thereof, preferably linked at least to one transit peptide as mentioned for example in table V.

In another embodiment, in the process of the present invention the activity of a b2818 protein is increased or generated in a subcellular compartment of the organism or organism cell such as in an organelle like a plastid or mitochondria.

The sequence of b2926 (Accession number NP_417401) from *Escherichia coli* has been published in Blattner et al., Science 277 (5331), 1453-1474 (1997), and its activity is being defined as "phosphoglycerate kinase". Accordingly, in one embodiment, the process of the present invention comprises the use of a "phosphoglycerate kinase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a b2926 protein is increased or generated, e.g. from *Escherichia coli* or a homolog thereof, preferably linked at least to one transit peptide as mentioned for example in table V.

In another embodiment, in the process of the present invention the activity of a b2926 protein is increased or generated in a subcellular compartment of the organism or organism cell such as in an organelle like a plastid or mitochondria.

The sequence of b2965 (Accession number NP_417440) from *Escherichia coli* has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a b2965 protein is increased or generated, e.g. from *Escherichia coli* or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b3443 (Accession number NP_417900) from *Escherichia coli* has been published in Blattner et al., Science 277 (5331), 1453-1474 (1997), and its activity is being defined as "conserved unknown protein". Accordingly, in one embodiment, the process of the present invention comprises the use of a "conserved unknown protein" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably glutamine in free or bound form in an organism or a part thereof, as mentioned. In one embodiment, in the process of the present invention the activity of a b3443 protein is increased or generated, e.g. from *Escherichia coli* or a homolog thereof, preferably linked at least to one transit peptide as mentioned for example in table V.

In another embodiment, in the process of the present invention the activity of a b3443 protein is increased or generated in a subcellular compartment of the organism or organism cell such as in an organelle like a plastid or mitochondria.

The sequence of b4072 (Accession number C57987) from *Escherichia coli* has been published in Blattner et al., Science 277 (5331), 1453-1474 (1997), and its activity is being defined as "formate-dependent nitrite reductase NrfC". Accordingly, in one embodiment, the process of the present invention comprises the use of a "formate-dependent nitrite reductase NrfC" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably glutamine in free or bound form in an organism or a part thereof, as mentioned. In one embodiment, in the process of the present invention the activity of a b4072 protein is increased or generated, e.g. from *Escherichia coli* or a homolog thereof, preferably linked at least to one transit peptide as mentioned for example in table V.

In another embodiment, in the process of the present invention the activity of a b4072 protein is increased or generated in a subcellular compartment of the organism or organism cell such as in an organelle like a plastid or mitochondria.

The sequence of b4074 (Accession number E57987) from *Escherichia coli* has been published in Blattner et al., Science 277 (5331), 1453-1474 (1997), and its activity is being defined as "formate-dependent nitrite reductase". Accordingly, in one embodiment, the process of the present invention comprises the use of a "formate-dependent nitrite reductase" or its homolog, e.g. as shown herein, for the production of the fine chemical, meaning of arginine, glutamate, glutamine and/or proline, in particular for increasing the amount of arginine, glutamate, glutamine and/or proline in free or bound form, preferably proline in free or bound form in an organism or a part thereof, as mentioned. In one embodiment, in the process of the present invention the activity of a b4074 protein is increased or generated, e.g. from *Escherichia coli* or a homolog thereof, preferably linked at least to one transit peptide as mentioned for example in table V.

In another embodiment, in the process of the present invention the activity of a b4074 protein is increased or generated in a subcellular compartment of the organism or organism cell such as in an organelle like a plastid or mitochondria.

The sequence of b4139 (Accession number NP_418562) from *Escherichia coli* has been published in Blattner et al., Science 277 (5331), 1453-1474 (1997), and its activity is being defined as "aspartate ammonia-lyase (aspartase)". Accordingly, in one embodiment, the process of the present invention comprises the use of a "aspartate ammonia-lyase" or its homolog, e.g. as shown herein, for the production of the fine chemical, meaning of arginine, glutamate, glutamine and/or proline, in particular for increasing the amount of arginine, glutamate, glutamine and/or proline in free or bound form preferably glutamine and/or arginine in free or bound form in an organism or a part thereof, as mentioned. In one embodiment, in the process of the present invention the activity of a b4139 protein is increased or generated, e.g. from *Escherichia coli* or a homolog thereof, preferably linked at least to one transit peptide as mentioned for example in table V.

In another embodiment, in the process of the present invention the activity of a b4139 protein is increased or generated in a subcellular compartment of the organism or organism cell such as in an organelle like a plastid or mitochondria.

The sequence of YGR262C (Accession number S64595) from *Saccharomyces cerevisiae* has been published in Tettelin et al., Nature 387 (6632 Suppl), 81-84 (1997), and Goffeau et al., Science 274 (5287), 546-547, 1996, and its activity is being defined as "protein involved in bud-site selection". Accordingly, in one embodiment, the process of the present invention comprises the use of a "protein involved in bud-site selection" or its homolog, e.g. as shown herein, for the production of the fine chemical, meaning of arginine, glutamate, glutamine and/or proline, in particular for increasing the amount of arginine, glutamate, glutamine and/or proline in free or bound form preferably glutamate in free or bound form in an organism or a part thereof, as mentioned. In one embodiment, in the process of the present invention the activity of a YGR262C protein is increased or generated, e.g. from *Saccharomyces cerevisiae* or a homolog thereof, preferably linked at least to one transit peptide as mentioned for example in table V.

In another embodiment, in the process of the present invention the activity of an YGR262C protein is increased or generated in a subcellular compartment of the organism or organism cell such as in an organelle like a plastid or mitochondria.

The sequence of YHR202W (Accession number NP_012072) from *Saccharomyces cerevisiae* has been published in Goffeau et al., Science 274 (5287), 546-547, 1996, and its activity is being defined as "uncharacterized protein". Accordingly, in one embodiment, the process of the present invention comprises the use of a "conserved protein" or its homolog, e.g. as shown herein, for the production of the fine chemical, meaning of arginine, glutamate, glutamine and/or proline, in particular for increasing the amount of arginine, glutamate, glutamine and/or proline in free or bound form preferably glutamate in free or bound form in an organism or a part thereof, as mentioned. In one embodiment, in the process of the present invention the activity of a YHR202W protein is increased or generated, e.g. from *Saccharomyces cerevisiae* or a homolog thereof, preferably linked at least to one transit peptide as mentioned for example in table V.

In another embodiment, in the process of the present invention the activity of an YHR202W protein is increased or generated in a subcellular compartment of the organism or organism cell such as in an organelle like a plastid or mitochondria.

The sequence of YMR262W (Accession number S54474) from *Saccharomyces cerevisiae* has been published in Bowman et al., Nature 387:90-93, (1997) and Goffeau et al., Science 274 (5287), 546-547, 1996, and its activity is being defined as "uncharacterized ORF". Accordingly, in one embodiment, the process of the present invention comprises the use of a "uncharacterized ORF" or its homolog, e.g. as shown herein, for the production of the fine chemical, meaning of arginine, glutamate, glutamine and/or proline, in particular for increasing the amount of arginine, glutamate, glutamine and/or proline in free or bound form preferably glutamate in free or bound form in an organism or a part thereof, as mentioned. In one embodiment, in the process of the present invention the activity of a YMR262W protein is increased or generated, e.g. from *Saccharomyces cerevisiae* or a homolog thereof, preferably linked at least to one transit peptide as mentioned for example in table V.

In another embodiment, in the process of the present invention the activity of an YMR262W protein is increased or generated in a subcellular compartment of the organism or organism cell such as in an organelle like a plastid or mitochondria.

The sequence of YPL162C (Accession number S65173) from *Saccharomyces cerevisiae* has been published in Goffeau et al., Science 274 (5287), 546-547, 1996 and Bussey et al., Nature 387 (6632 Suppl), 103-105 (1997) and its activity is being defined as "probable membrane protein". Accordingly, in one embodiment, the process of the present invention comprises the use of a "probable membrane protein" or its homolog, e.g. as shown herein, for the production of the fine chemical, meaning of arginine, glutamate, glutamine and/or proline, in particular for increasing the amount of arginine, glutamate, glutamine and/or proline in free or bound form preferably glutamine in free or bound form in an organism or a part thereof, as mentioned. In one embodiment, in the process of the present invention the activity of a YPL162C protein is increased or generated, e.g. from *Saccharomyces cerevisiae* or a homolog thereof, preferably linked at least to one transit peptide as mentioned for example in table V.

In another embodiment, in the process of the present invention the activity of an YPL162C protein is increased or generated in a subcellular compartment of the organism or organism cell such as in an organelle like a plastid or mitochondria.

The sequence of YAL038W (Accession number NP_009362) from *Saccharomyces cerevisiae* has been published in Goffeau et al., Science 274 (5287), 546-547, 1996 and Bussey et al., Proc. Natl. Acad. Sci. U.S.A. 92 (9), 3809-3813 (1995), and its activity is being defined as "pyruvate kinase", which functions as a homotetramer in glycolysis to convert phosphoenolpyruvate to pyruvate (Cdc19p). Pyruvate is the input for aerobic (TCA cycle) or anaerobic (glucose fermentation) respiration. Accordingly, in one embodiment, the process of the present invention comprises the use of a "pyruvate kinase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YAL038W protein is increased or generated, e.g. from *Saccharomyces cerevisiae* or a homolog thereof, preferably linked at least to one transit peptide as mentioned for example in table V.

In another embodiment, in the process of the present invention the activity of an YAL038W protein is increased or generated in a subcellular compartment of the organism or organism cell such as in an organelle like a plastid or mitochondria.

The sequence of YBR001C (Accession number NP_009555) from *Saccharomyces cerevisiae* has been published in Goffeau et al., Science 274 (5287), 546-547, 1996 and Feldmann et al., EMBO J. 13 (24), 5795-5809 (1994), and its activity is being defined as "neutral trehalase" which degrades trehalose and which is required for thermotolerance and may mediate resistance to other cellular stresses (Nth2p). Accordingly, in one embodiment, the process of the present invention comprises the use of a "neutral trehalase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YBR001C protein is increased or generated, e.g. from *Saccharomyces cerevisiae* or a homolog thereof, preferably linked at least to one transit peptide as mentioned for example in table V.

In another embodiment, in the process of the present invention the activity of an YBR001C protein is increased or generated in a subcellular compartment of the organism or organism cell such as in an organelle like a plastid or mitochondria.

The sequence of YER024W (Accession number NP_010941) from *Saccharomyces cerevisiae* has been published in Goffeau et al., Science 274 (5287), 546-547, 1996 and Dietrich et al., Nature 387 (6632 Suppl), 78-81 (1997). The activity of the protein is unclear. The protein shows significant homology with the known carnitine acetyltransferase associated with the outer-mitochondrial membrane (Yat1p), and might also functions as a carnitine acetyltransferase. Accordingly, in one embodiment, the process of the present invention comprises the use of said putative carnitine acetyltransferase or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YER024W protein is increased or generated, e.g. from *Saccharomyces cerevisiae* or a homolog thereof, preferably linked at least to one transit peptide as mentioned for example in table V.

In another embodiment, in the process of the present invention the activity of a YER024W protein is increased or generated in a subcellular compartment of the organism or organism cell such as in an organelle like a plastid or mitochondria.

The sequence of YGR256W (Accession number NP_011772) from *Saccharomyces cerevisiae* has been published in Goffeau et al., Science 274 (5287), 546-547, 1996 and Tettelin et al., Nature 387 (6632 Suppl), 81-84 (1997), and its activity is being defined as "6-phosphogluconate dehydrogenase", which has a decarboxylating activity and converts 6-phosphogluconate+NADP to ribulose-5-phosphate+NADPH+$CO_2$ (Gnd2p). Accordingly, in one embodiment, the process of the present invention comprises the use of a "6-phosphogluconate dehydrogenase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YGR256W protein is increased or generated, e.g. from *Saccharomyces cerevisiae* or a homolog thereof, preferably linked at least to one transit peptide as mentioned for example in table V.

In another embodiment, in the process of the present invention the activity of an YGR256W protein is increased or generated in a subcellular compartment of the organism or organism cell such as in an organelle like a plastid or mitochondria.

The sequence of YGR289C (Accession number NP_011805) from *Saccharomyces cerevisiae* has been published in Goffeau et al., Science 274 (5287), 546-547, 1996 and Tettelin et al., Nature 387 (6632 Suppl), 81-84 (1997), and its activity is being defined as "general alpha-glucoside permease". Accordingly, in one embodiment, the process of the present invention comprises the use of a "general alpha-glucoside permease" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YGR289C protein is increased or generated, e.g. from *Saccharomyces cerevisiae* or a homolog thereof, preferably linked at least to one transit peptide as mentioned for example in table V.

In another embodiment, in the process of the present invention the activity of an YGR289C protein is increased or generated in a subcellular compartment of the organism or organism cell such as in an organelle like a plastid or mitochondria. the sequence of YHR037W (Accession number NP_011902) from *Saccharomyces cerevisiae* has been published in Goffeau et al., Science 274 (5287), 546-547, 1996 and Johnston et al., Science 265 (5181), 2077-2082 (1994), and its activity is being defined as "delta-1-pyrroline-5-carboxylate dehydrogenase". Accordingly, in one embodiment, the process of the present invention comprises the use of a "delta-1-pyrroline-5-carboxylate dehydrogenase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YHR037W protein is increased or generated, e.g. from *Saccharomyces cerevisiae* or a homolog thereof, preferably linked at least to one transit peptide as mentioned for example in table V.

In another embodiment, in the process of the present invention the activity of an YHR037W protein is increased or generated in a subcellular compartment of the organism or organism cell such as in an organelle like a plastid or mitochondria.

The sequence of YKR043C (Accession number NP_012969) from *Saccharomyces cerevisiae* has been published in Goffeau et al., Science 274 (5287), 546-547, 1996 and Dujon et al., Nature 369 (6479), 371-378 (1994), and its activity is being defined as "phosphoglycerate mutase like protein". Accordingly, in one embodiment, the process of the present invention comprises the use of a "phosphoglycerate mutase like protein" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YKR043C protein is increased or generated, e.g. from *Saccharomyces cerevisiae* or a homolog thereof, preferably linked at least to one transit peptide as mentioned for example in table V.

In another embodiment, in the process of the present invention the activity of an YKR043C protein is increased or generated in a subcellular compartment of the organism or organism cell such as in an organelle like a plastid or mitochondria.

The sequence of YLRO27C (Accession number NP_013127) from *Saccharomyces cerevisiae* has been published in Goffeau et al., Science 274 (5287), 546-547, 1996 and Johnston et al., Science 265 (5181), 2077-2082 (1994), and its activity is being defined as "aspartate aminotransferase". Accordingly, in one embodiment, the process of the present invention comprises the use of a "aspartate aminotransferase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YLRO27C protein is increased or generated, e.g. from *Saccharomyces cerevisiae* or a homolog thereof, preferably linked at least to one transit peptide as mentioned for example in table V.

In another embodiment, in the process of the present invention the activity of an YLRO27C protein is increased or generated in a subcellular compartment of the organism or organism cell such as in an organelle like a plastid or mitochondria.

The sequence of YNL241C (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as "glucose-6-phosphate dehydrogenase" (Zwf1p). Accordingly, in one embodiment, the process of the present invention comprises the use of a "glucose-6-phosphate dehydrogenase" or its homolog, e.g. as shown herein, for the production of the fine chemical, meaning of arginine, glutamate, glutamine and/or proline, in particular for increasing the amount of arginine, glutamate, glutamine and/or proline in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of an YNL241C protein is increased or generated in a subcellular compartment of the organism or organism cell such as in an organelle like a plastid or mitochondria.

In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C, is a homolog having said activity and being derived from Eukaryot. In one embodiment, the homolog of the b0342, b0855, b1062, b1184, b1223, b1556, b1758, b2040, b3443, b4072, b4074, b1264, b1852, b1907, b2025, b2818, b2926, b2965 and/or b4139 is a homolog having said activity and being derived from bacteria. In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C is a homolog having said activity and being derived from Fungi. In one embodiment, the homolog of the b0342, b0855, b1062, b1184, b1223, b1556, b1758, b2040, b3443, b4072, b4074, b1264, b1852, b1907, b2025, b2818, b2926, b2965 and/or b4139 is a homolog having said activity and being derived from Proteobacteria. In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C is a homolog having said activity and being derived from Ascomycota. In one embodiment, the homolog of the b0342, b0855, b1062, b1184, b1223, b1556, b1758, b2040, b3443, b4072, b4074, b1264, b1852, b1907, b2025, b2818, b2926, b2965 and/or b4139 is a homolog having said activity and being derived from Gammaproteobacteria. In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C is a homolog having said activity and being derived from *Saccharomycotina*. In one embodiment, the homolog of the b0342, b0855, b1062, b1184, b1223, b1556, b1758, b2040, b3443, b4072, b4074, b1264, b1852, b1907, b2025, b2818, b2926, b2965 and/or b4139 is a homolog having said activity and being derived from Enterobacteriales. In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C is a homolog having said activity and being derived from *Saccharomycetes*. In one embodiment, the homolog of the b0342, b0855, b1062, b1184, b1223, b1556, b1758, b2040, b3443, b4072, b4074, b1264, b1852, b1907, b2025, b2818, b2926, b2965 and/or b4139 is a homolog having said activity and being derived from Enterobacteriaceae. In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C is a homolog having said activity and being derived from *Saccharomycetales*. In one embodiment, the homolog of the b0342, b0855, b1062, b1184, b1223, b1556, b1758, b2040, b3443, b4072, b4074, b1264, b1852, b1907, b2025, b2818, b2926, b2965 and/or b4139 is a homolog having said activity and being derived from *Escherichia*, preferably from *Escherichia coli*. In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C is a homolog having said activity and being derived from Saccharomycetaceae. In one embodiment, the homolog of the YGR262C, YHR202W, YMR262W, YPL162C, YAL038W, YBR001C, YER024W, YGR256W, YGR289C, YHR037W, YKR043C, YLR027C and/or YNL241C is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 5, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 5, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 5, column 3, or which has at least 10% of the original enzymatic activity, preferably 20%, particularly preferably 30%, most particularly preferably 40% in comparison to a protein as shown in table II, application no. 5, column 3 of *Saccharomyces cerevisiae*.

for the disclosure of the paragraphs [0040.0.0.4] to [0047.0.0.4] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 5, column 3 its biochemical or genetical causes and the increased amount of the fine chemical.

for the disclosure of the paragraphs [0049.0.0.4] to [0051.0.0.4] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 5, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.4] to [0058.0.0.4] see paragraphs [0053.0.0.0] to [0058.0.0.0] above.

In case the activity of the *Escherichia coli* protein b0342 or its homologs, e.g. a "thiogalactoside acetyltransferase" is increased advantageously in an organelle such as a plastid or mitochondria, preferably, in one embodiment an increase of the fine chemical, preferably of glutamine between 29% and 81% and/or glutamate between 33% and 85% or more is conferred.

In case the activity of the *Escherichia coli* protein b0855 or its homologs, e.g. a "ATP-binding component of putrescine transport system" is increased advantageously in an organelle such as a plastid or mitochondria, preferably, in one embodiment an increase of the fine chemical, preferably of arginine between 46% and 113% or more is conferred.

In case the activity of the *Escherichia coli* protein b1062 or its homologs, e.g. a "dihydro-orotase" is increased advantageously in an organelle such as a plastid or mitochondria, preferably, in one embodiment an increase of the fine chemical, preferably of proline between 43% and 145% or more is conferred.

In case the activity of the *Escherichia coli* protein b1184 or its homologs, e.g. a "SOS mutagenesis and repair" is increased advantageously in an organelle such as a plastid or mitochondria, preferably, in one embodiment an increase of the fine chemical, preferably of proline between 34% and 130% or more is conferred.

In case the activity of the *Escherichia coli* protein b1223 or its homologs, e.g. a "nitrite extrusion protein" is increased advantageously in an organelle such as a plastid or mitochondria, preferably, in one embodiment an increase of the fine chemical, preferably of proline between 44% and 501% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of proline between 45% and 229% or more is conferred.

In case the activity of the *Escherichia coli* protein b1758 or its homologs, e.g. a "putative cytochrome oxidase" is increased advantageously in an organelle such as a plastid or mitochondria, preferably, in one embodiment an increase of the fine chemical, preferably of glutamate between 36% and 38% or more is conferred.

In case the activity of the *Escherichia coli* protein b2040 or its homologs, e.g. a "TDP-rhamnose synthetase, NAD(P)-binding" is increased advantageously in an organelle such as a plastid or mitochondria, preferably, in one embodiment an increase of the fine chemical, preferably of glutamine between 32% and 49% or more is conferred. In case the activity of the *Escherichia coli* protein b3443 or its homologs, e.g. a "conserved unknown protein" is increased advantageously in an organelle such as a plastid or mitochondria, preferably, in one embodiment an increase of the fine chemical, preferably of glutamine between 30% and 36% or more is conferred.

In case the activity of the *Escherichia coli* protein b4072 or its homologs, e.g. a "formate-dependent nitrite reductase NrfC" is increased advantageously in an organelle such as a plastid or mitochondria, preferably, in one embodiment an increase of the fine chemical, preferably of glutamine between 33% and 451% or more is conferred. In case the activity of the *Escherichia coli* protein b4074 or its homologs, e.g. a "formate-dependent nitrite reductase" is increased advantageously in an organelle such as a plastid or mitochondria, preferably, in one embodiment an increase of the fine chemical, preferably of proline between 45% and 62% or more is conferred.

In case the activity of the *Escherichia coli* protein b1264 or its homologs, e.g. a "anthranilate synthase (component I)" is increased advantageously in an organelle such as a plastid or mitochondria, preferably, in one embodiment an increase of the fine chemical, preferably of glutamine between 27% and 75% or more is conferred.

In case the activity of the *Escherichia coli* protein b1852 or its homologs, e.g. a "glucose-6-phosphate dehydrogenase" is increased advantageously in an organelle such as a plastid or mitochondria, preferably, in one embodiment an increase of the fine chemical, preferably of proline between 45% and 62% or more is conferred.

In case the activity of the *Escherichia coli* protein b1907 or its homologs, e.g. a "tyrosine-specific transport protein" is increased advantageously in an organelle such as a plastid or mitochondria, preferably, in one embodiment an increase of the fine chemical, preferably of arginine between 46% and 113% or more is conferred.

In case the activity of the *Escherichia coli* protein b2025 or its homologs, e.g. a "imidazole glycerol phosphate synthase subunit" is increased advantageously in an organelle such as a plastid or mitochondria, preferably, in one embodiment an increase of the fine chemical, preferably of proline between 38% and 353% or more is conferred.

In case the activity of the *Escherichia coli* protein b2818 or its homologs, e.g. a "N-acetylglutamate synthase" is increased advantageously in an organelle such as a plastid or mitochondria, preferably, in one embodiment an increase of the fine chemical, preferably of arginine between 333% and 1336% or more is conferred.

In case the activity of the *Escherichia coli* protein b2926 or its homologs, e.g. a "phosphoglycerate kinase" is increased advantageously in an organelle such as a plastid or mitochondria, preferably, in one embodiment an increase of the fine chemical, preferably of proline between 34% and 130% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of proline between 60% and 855% or more is conferred.

In case the activity of the *Escherichia coli* protein b4139 or its homologs, e.g. a "aspartate ammonia-lyase" is increased advantageously in an organelle such as a plastid or mitochondria, preferably, in one embodiment an increase of the fine chemical, preferably of glutamine between 38% and 100% and/or arginine between 106% and 1038% or more is conferred.

In case the activity of the *Saccharomyces cerevisiae* protein YGR262C or its homologs, e.g. a "protein involved in bud-site selection" is increased advantageously in an organelle such as a plastid or mitochondria, preferably, in one embodiment an increase of the fine chemical, preferably of glutamate between 33% and 48% or more is conferred.

In case the activity of the *Saccharomyces cerevisiae* protein YHR202W or its homologs, e.g. a "uncharacterized protein" is increased advantageously in an organelle such as a plastid or mitochondria, preferably, in one embodiment an increase of the fine chemical, preferably of glutamate between 33% and 34% or more is conferred.

In case the activity of the *Saccharomyces cerevisiae* protein YMR262W or its homologs, e.g. a "uncharacterized ORF" is increased advantageously in an organelle such as a plastid or mitochondria, preferably, in one embodiment an increase of the fine chemical, preferably of glutamate between 35% and 128% or more is conferred.

In case the activity of the *Saccharomyces cerevisiae* protein YPL162C or its homologs, e.g. a "probable membrane protein" is increased advantageously in an organelle such as a plastid or mitochondria, preferably, in one embodiment an increase of the fine chemical, preferably of glutamine between 28% and 59% or more is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably of proline between 41% and 101% or more or and/or glutamate between 58% and 120% or more is conferred.

In case the activity of the *Saccharomyces cerevisiae* protein YBR001C or its homologs, e.g. a "neutral trehalase" is increased advantageously in an organelle such as a plastid or mitochondria, preferably, in one embodiment an increase of the fine chemical, preferably of proline between 33% and 66% or more is conferred.

In case the activity of the *Saccharomyces cerevisiae* protein YER024W or its homologs, e.g. a "carnitine acetyltransferase" is increased advantageously in an organelle such as a plastid or mitochondria, preferably, in one embodiment an increase of the fine chemical, preferably of arginine between 24% and 39% or more is conferred.

In case the activity of the *Saccharomyces cerevisiae* protein YGR256W or its homologs, e.g. a "6-phospho-gluconate dehydrogenase" is increased advantageously in an organelle such as a plastid or mitochondria, preferably, in one embodiment an increase of the fine chemical, preferably of proline between 54% and 122% or more is conferred.

In case the activity of the *Saccharomyces cerevisiae* protein YGR289C or its homologs, e.g. a "general alpha-glucoside permease" is increased advantageously in an organelle such as a plastid or mitochondria, preferably, in one embodiment an increase of the fine chemical, preferably of proline between 37% and 82% or more is conferred.

In case the activity of the *Saccharomyces cerevisiae* protein YHR037W or its homologs, e.g. a "delta-1-pyrroline-5-carboxylate dehydrogenase" is increased advantageously in an organelle such as a plastid or mitochondria, preferably, in one embodiment an increase of the fine chemical, preferably of proline between 71% and 117% or more is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably, in one embodiment an increase of the fine chemical, preferably of proline between 34% and 330% or more is conferred.

In case the activity of the *Saccharomyces cerevisiae* protein YLR027C or its homologs, e.g. a "aspartate aminotransferase" is increased advantageously in an organelle such as a plastid or mitochondria, preferably, in one embodiment an increase of the fine chemical, preferably of proline between 52% and 182% or more is conferred.

In case the activity of the *Saccharomyces cerevisiae* protein YNL241C or its homologs, e.g. an "glucose-6-phosphate dehydrogenase" is increased advantageously in an organelle such as a plastid or mitochondria, preferably, in one embodiment an increase of the fine chemical, preferably of arginine between 48% and 274% or more is conferred.

In case the activity of the *Escherichia coli* protein b0342 or its homologs, e.g. a "thiogalactoside acetyltransferase" is increased advantageously in an organelle such as a plastid or mitochondria, preferably an increase of the fine chemical and of proteins containing glutamine and/or glutamate is conferred.

In case the activity of the *Escherichia coli* protein b0855 or its homologs, e.g. a "ATP-binding component of putrescine transport system" is increased advantageously in an organelle such as a plastid or mitochondria, preferably an increase of the fine chemical and of proteins containing arginine is conferred.

In case the activity of the *Escherichia coli* protein b1062 or its homologs, e.g. a "dihydro-orotase" is increased advantageously in an organelle such as a plastid or mitochondria, preferably an increase of the fine chemical and of proteins containing proline is conferred.

In case the activity of the *Escherichia coli* protein b1184 or its homologs, e.g. a "SOS mutagenesis and repair" is increased advantageously in an organelle such as a plastid or mitochondria, preferably an increase of the fine chemical and of proteins containing proline is conferred.

In case the activity of the *Escherichia coli* protein b1223 or its homologs, e.g. a "nitrite extrusion protein" is increased advantageously in an organelle such as a plastid or mitochondria, preferably an increase of the fine chemical and of proteins containing proline is conferred.

In case the activity of the *Escherichia coli* protein b1556 or its homologs, e.g. a "Qin prophage" is increased advantageously in an organelle such as a plastid or mitochondria, preferably an increase of the fine chemical and of proteins containing proline is conferred.

In case the activity of the *Escherichia coli* protein b1758 or its homologs, e.g. a "putative cytochrome oxidase" is increased advantageously in an organelle such as a plastid or mitochondria, preferably an increase of the fine chemical and of proteins containing glutamate is conferred.

In case the activity of the *Escherichia coli* protein b2040 or its homologs, e.g. a "TDP-rhamnose synthetase, NAD(P)-binding" is increased advantageously in an organelle such as a plastid or mitochondria, preferably an increase of the fine chemical and of proteins containing glutamine is conferred.

In case the activity of the *Escherichia coli* protein b3443 or its homologs, e.g. a "conserved unknown protein" is increased advantageously in an organelle such as a plastid or mitochondria, preferably an increase of the fine chemical and of proteins containing glutamine is conferred.

In case the activity of the *Escherichia coli* protein b4072 or its homologs, e.g. a "formate-dependent nitrite reductase NrfC" is increased advantageously in an organelle such as a plastid or mitochondria, preferably an increase of the fine chemical and of proteins containing glutamine is conferred.

In case the activity of the *Escherichia coli* protein b4074 or its homologs, e.g. a "formate-dependent nitrite reductase" is increased advantageously in an organelle such as a plastid or mitochondria, preferably an increase of the fine chemical and of proteins containing proline is conferred.

In case the activity of the *Escherichia coli* protein b1264 or its homologs, e.g. a "anthranilate synthase (component 1)" is increased advantageously in an organelle such as a plastid or mitochondria, preferably an increase of the fine chemical and of proteins containing glutamine is conferred.

In case the activity of the *Escherichia coli* protein b1852 or its homologs, e.g. a "glucose-6-phosphate dehydrogenase" is increased advantageously in an organelle such as a plastid or mitochondria, preferably an increase of the fine chemical and of proteins containing proline is conferred.

In case the activity of the *Escherichia coli* protein b1907 or its homologs, e.g. a "tyrosine-specific transport protein" is increased advantageously in an organelle such as a plastid or mitochondria, preferably an increase of the fine chemical and of proteins containing arginine is conferred.

In case the activity of the *Escherichia coli* protein b2025 or its homologs, e.g. a "imidazole glycerol phosphate synthase subunit" is increased advantageously in an organelle such as a plastid or mitochondria, preferably an increase of the fine chemical and of proteins containing proline is conferred.

In case the activity of the *Escherichia coli* protein b2818 or its homologs, e.g. a "N-acetylglutamate synthase" is increased advantageously in an organelle such as a plastid or mitochondria, preferably an increase of the fine chemical and of proteins containing arginine is conferred.

In case the activity of the *Escherichia coli* protein b2926 or its homologs, e.g. a "phosphoglycerate kinase" is increased advantageously in an organelle such as a plastid or mitochondria, preferably an increase of the fine chemical and of proteins containing proline is conferred.

In case the activity of the *Escherichia coli* protein b2965 or its homologs, e.g. a "ornithine decarboxylase" is increased advantageously in an organelle such as a plastid or mitochondria, preferably an increase of the fine chemical and of proteins containing proline is conferred.

In case the activity of the *Escherichia coli* protein b4139 or its homologs, e.g. a "aspartate ammonia-lyase" is increased advantageously in an organelle such as a plastid or mitochondria, preferably an increase of the fine chemical and of proteins containing glutamine and/or arginine is conferred.

In case the activity of the *Saccharomyces cerevisiae* protein YGR262C or its homologs, e.g. a "protein involved in bud-site selection" is increased advantageously in an organelle such as a plastid or mitochondria, preferably an increase of the fine chemical and of proteins containing glutamate is conferred.

In case the activity of the *Saccharomyces cerevisiae* protein YHR202W or its homologs, e.g. a "uncharacterized protein" is increased advantageously in an organelle such as a plastid or mitochondria, preferably an increase of the fine chemical and of proteins containing glutamate is conferred.

In case the activity of the *Saccharomyces cerevisiae* protein YMR262W or its homologs, e.g. a "uncharacterized ORF" is increased advantageously in an organelle such as a plastid or mitochondria, preferably an increase of the fine chemical and of proteins containing glutamate is conferred.

In case the activity of the *Saccharomyces cerevisiae* protein YPL162C or its homologs, e.g. a "probable membrane protein" is increased advantageously in an organelle such as a plastid or mitochondria, preferably an increase of the fine chemical and of proteins containing glutamine is conferred.

In case the activity of the *Saccharomyces cerevisiae* protein YAL038W or its homologs, e.g. a "pyruvate kinase" is increased advantageously in an organelle such as a plastid or mitochondria, preferably an increase of the fine chemical and of proteins containing proline and/or glutamate is conferred.

In case the activity of the *Saccharomyces cerevisiae* protein YBR001C or its homologs, e.g. a "neutral trehalase" is increased advantageously in an organelle such as a plastid or mitochondria, preferably an increase of the fine chemical and of proteins containing proline is conferred.

In case the activity of the *Saccharomyces cerevisiae* protein YER024W or its homologs, e.g. a "carnitine acetyltransferase" is increased advantageously in an organelle such as a plastid or mitochondria, preferably an increase of the fine chemical and of proteins containing arginine is conferred.

In case the activity of the *Saccharomyces cerevisiae* protein YGR256W or its homologs, e.g. a "6-phospho-gluconate dehydrogenase" is increased advantageously in an organelle such as a plastid or mitochondria, preferably an increase of the fine chemical and of proteins containing proline is conferred.

In case the activity of the *Saccharomyces cerevisiae* protein YGR289C or its homologs, e.g. a "general alpha-glucoside permease" is increased advantageously in an organelle such as a plastid or mitochondria, preferably an increase of the fine chemical and of proteins containing proline is conferred.

In case the activity of the *Saccharomyces cerevisiae* protein YHR037W or its homologs, e.g. a "delta-1-pyrroline-5-carboxylate dehydrogenase" is increased advantageously in an organelle such as a plastid or mitochondria, preferably an increase of the fine chemical and of proteins containing proline is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably an increase of the fine chemical and of proteins containing proline is conferred.

In case the activity of the *Saccharomyces cerevisiae* protein YLR027C or its homologs, e.g. a "aspartate aminotransferase" is increased advantageously in an organelle such as a plastid or mitochondria, preferably an increase of the fine chemical and of proteins containing proline is conferred.

In case the activity of the *Saccharomyces cerevisiae* protein YNL241C or its homologs, e.g. an "glucose-6-phosphate dehydrogenase" is increased advantageously in an organelle such as a plastid or mitochondria, preferably, in one embodiment an increase of the fine chemical, preferably an increase of the fine chemical and of proteins containing arginine is conferred.

for the disclosure of the paragraphs [0061.0.0.4] and [0062.0.0.4] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 5, column 7 or of the polypeptide as shown in the amino acid sequences as disclosed in table II, application no. 5, columns 5 and 7 or the functional homologues thereof as described herein, or is encoded by the nucleic acid molecule characterized herein or the nucleic acid molecule according to the invention, for example by the nucleic acid molecule as shown in table I, application no. 5, columns 5 and 7 or its herein described functional homologues and has the herein mentioned activity.

For the purposes of the present invention, the terms "L-arginine, L-glutamate, L-glutamine and/or L-proline" and "arginine, glutamate, glutamine and/or proline" also encompass the corresponding salts, such as, for example, arginine, glutamate, glutamine and/or proline hydrochloride or arginine, glutamate, glutamine and/or proline sulfate. Preferably the terms arginine, glutamate, glutamine and/or proline is intended to encompass the term L-arginine, L-glutamate, L-glutamine and/or L-proline.

for the disclosure of the paragraphs [0065.0.0.4] and [0066.0.0.4] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 5, columns 5 and 7 or its homologs activity having herein-mentioned arginine, glutamate, glutamine and/or proline increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 5, columns 5 and 7, e.g. a nucleic acid sequence encoding a polypeptide having the activity of a protein as indicated in table II, application no. 5, columns 5 and 7 or its homologs activity or of a mRNA encoding the polypeptide of the present invention having herein-mentioned arginine, glutamate, glutamine and/or proline increasing activity; and/or c) increasing the specific activity of a protein conferring the increased expression of a protein encoded by the nucleic acid molecule of the invention or of the polypeptide of the present invention having herein-mentioned arginine, glutamate, glutamine and/or proline increasing activity, e.g. of a polypeptide having the activity of a protein as indicated in table II, application no. 5, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned arginine, glutamate, glutamine and/or proline increasing activity, e.g. of a polypeptide having the activity of a protein as indicated in table II, application no. 5, columns 5 and 7 or its homologs activity; and/or e) stimulating activity of a protein conferring the increased expression of a protein encoded by the nucleic acid molecule of the present invention or a polypeptide of the present invention having herein-mentioned arginine, glutamate, glutamine and/or proline increasing activity, e.g. of a polypeptide having the activity of a protein as indicated in table II, application no. 5, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned arginine, glutamate, glutamine and/or proline increasing activity, e.g. of a polypeptide having the activity of a protein as indicated in table II, application no. 5, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned arginine, glutamate, glutamine and/or proline increasing activity, e.g. of a polypeptide having the activity of a protein as indicated in table II, application no. 5, columns 5 and 7 or its homologs activity; and/or h) increasing the expression of the endogenous gene encoding the polypeptide of the invention, e.g. a polypeptide having the activity of a protein as indicated in table II, application no. 5, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned arginine, glutamate, glutamine and/or proline increasing activity, e.g. of a polypeptide having the activity of a protein as indicated in table II, application no. 5, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned arginine, glutamate, glutamine and/or proline increasing activity, e.g. of a polypeptide having the activity of a protein as indicated in table II, application no. 5, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned arginine, glutamate, glutamine and/or proline increasing activity, e.g. of a polypeptide having the activity of a protein as indicated in table II, application no. 5, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 5, column 3 or its homologs. Preferably the increase of the fine chemical takes place in plastids.

for the disclosure of the paragraphs [0069.0.0.4] to [0079.0.0.4] see paragraphs [0069.0.0.0] to [0079.0.0.0] above.

The activation of an endogenous polypeptide having above-mentioned activity, e.g. having the activity of a protein as shown in table II, application no. 5, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 5, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 5, column 3. The expression of the chimeric transcription factor in a organism, in particular in a plant, leads to a specific expression of the protein as shown in table II, application no. 5, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.4] to [0084.0.0.4] see paragraphs [0081.0.0.0] to [0084.0.0.0] above.

Owing to the introduction of a gene or a plurality of genes conferring the expression of the nucleic acid molecule of the invention or the polypeptide of the invention, for example the nucleic acid construct mentioned below, or encoding the protein as shown in table II, application no. 5, column 3 into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutritional physiology limited) amino acids, like methionine, lysine or threonine alone or in combination in free or bound form.

for the disclosure of this paragraph see paragraph [0086.0.0.0] above.

By influencing the metabolism thus, it is possible to produce, in the process according to the invention, further advantageous compounds. Examples of such compounds are, in addition to arginine, glutamate, glutamine and/or proline for example compounds like amino acids such as methionine, threonine or lysine or other desirable compounds.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 5, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound amino acids, in particular arginine, glutamate, glutamine and/or proline.

for the disclosure of the paragraphs [0090.0.0.4] to [0097.0.0.4] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 5, columns 5 and 7 or a derivative thereof, or b) a genetic regulatory element, for example a promoter, which is functionally linked to the nucleic acid sequence as shown table I, application no. 5, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 5, columns 5 and 7 joined to a nucleic acid sequence encoding a transit peptide, or a targeting nucleic acid sequence which directs the nucleic acid sequences disclosed in table I, application no. 5, columns 5 and 7 to the organelle preferentially the plastids. Altenatively the inventive nucleic acids sequences consist advantageously of the nucleic acid sequences as depicted in the sequence protocol and disclosed in table I, application no. 5, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine. After the activity of the protein as shown in table II, application no. 5, column 3 has been increased or generated in the cytsol or plastids, preferentially in the plastids, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.4] to [0110.0.0.4] see paragraphs [0102.0.0.0] to [0110.0.0.0] above.

In a preferred embodiment, the fine chemical (arginine, glutamate, glutamine and/or proline) is produced in accordance with the invention and, if desired, is isolated. The production of further amino acids such as lysine, methionine, threonine, tryptophane etc. and of amino acid mixtures by the process according to the invention is advantageous.

for the disclosure of the paragraphs [0112.0.0.4] to [0115.0.0.4] see paragraphs [0112.0.0.0] to [0115.0.0.0] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:
a) nucleic acid molecule encoding, preferably at least the mature form, of the polypeptide shown in table II, application no. 5, columns 5 and 7 or a fragment thereof, which confers an increase in the amount of the fine chemical in an organism or a part thereof;
b) nucleic acid molecule comprising, preferably at least the mature form, of the nucleic acid molecule shown in table I, application no. 5, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybidizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 5, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 5, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 5, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 5, columns 5 and 7 by one or more nucleotides. In one embodiment, the nucleic acid molecule used in the process of the invention does not consist of the sequence indicated in table IA, application no. 5, columns 5 and 7. In one embodiment, the nucleic acid molecule used in the process of the invention is less than 100%, 99.999%, 99.99%, 99.9% or 99% identical to a sequence indicated in table IA, application no. 5, columns 5 and 7. In another embodiment, the nucleic acid molecule does not encode a polypeptide of a sequence indicated in table IIA, application no. 5, columns 5 and 7.

In one embodiment, the nucleic acid molecule used in the process of the invention distinguishes over the sequence indicated in table IB, application no. 5, columns 5 and 7, by one or more nucleotides. In one embodiment, the nucleic acid molecule used in the process of the invention does not consist of the sequence indicated in table IB, application no. 5, columns 5 and 7. In one embodiment, the nucleic acid molecule used in the process of the invention is less than 100%, 99.999%, 99.99%, 99.9% or 99% identical to a sequence indicated in table IB, application no. 5, columns 5 and 7. In another embodiment, the nucleic acid molecule does not encode a polypeptide of a sequence indicated in table IIB, application no. 5, columns 5 and 7.

In one embodiment, the nucleic acid molecule used in the process distinguishes over the sequence shown in table I, application no. 5, columns 5 and 7 by one or more nucleotides or does not consist of the sequence shown in table I, application no. 5, columns 5 and 7. In one embodiment, the nucleic acid molecule of the present invention is less than 100%, 99.999%, 99.99%, 99.9% or 99% identical to the sequence shown in table I, application no. 5, columns 5 and 7. In another embodiment, the nucleic acid molecule does not encode a polypeptide of the sequence shown in table II, application no. 5, columns 5 and 7.

for the disclosure of the paragraphs [0118.0.0.4] to [0120.0.0.4] see paragraphs [0118.0.0.0] to [0120.0.0.0] above.

Nucleic acid molecules with the sequence shown in table I, application no. 5, columns 5 and 7, nucleic acid molecules which are derived from the amino acid sequences shown in table II, application no. 5, columns 5 and 7 or from polypeptides comprising the consensus sequence shown in table IV, application no. 5, column 7, or their derivatives or homologues encoding polypeptides with the enzymatic or biological activity of a protein as shown in table II, application no. 5, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 5, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 5, column 3 and conferring the fine chemical increase by expression either in the cytsol or in an organelle such as a plastid or mitochondria or both, preferably in plastids.

for the disclosure of the paragraphs [0126.0.0.4] to [0133.0.0.4] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 5, columns 5 and 7 or the functional homologues thereof as described herein, preferably conferring above-mentioned activity, i.e. conferring the fine chemical increase after increasing its activity, e.g. after increasing the activity of a protein as shown in table II, column 3 by for example expression either in the cytsol or in an organelle such as a plastid or mitochondria or both, preferably in plastids.

for the disclosure of the paragraphs [0135.0.0.4] to [0140.0.0.4] see paragraphs [0135.0.0.0] to [0140.0.0.0] above.

Synthetic oligonucleotide primers for the amplification, e.g. as shown in table III, application no. 5, column 7, by means of polymerase chain reaction can be generated on the basis of a sequence shown herein, for example the sequence shown in table I, application no. 5, columns 5 and 7 or the sequences derived from table II, application no. 5, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 5, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 5, column 3 or further functional homologs of the polypeptide of the invention from other organisms.

for the disclosure of the paragraphs [0144.0.0.4] to [0151.0.0.4] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 5, columns 5 and 7, preferably shown in table IB, application no. 5, columns 5 and 7 under relaxed hybridization conditions and which code on expression for peptides having the methionine increasing activity.

for the disclosure of the paragraphs [0153.0.0.4] to [0159.0.0.4] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 5, columns 5 and 7, preferably shown in table IB, application no. 5, columns 5 and 7 is one which is sufficiently complementary to one of the nucleotide sequences shown in table I, application no. 5, columns 5 and 7, preferably shown in table IB, application no. 5, columns 5 and 7 such that it can hybridize to one of the nucleotide sequences shown in table I, application no. 5, columns 5 and 7, preferably shown in table IB, application no. 5, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 5, columns 5 and 7, preferably shown in table IB, application no. 5, columns 5 and 7, or a portion thereof and preferably has above mentioned activity, in particular having a fine chemical increasing activity after increasing the activity or an activity of a gene product as shown in table II, application no. 5, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 5, columns 5 and 7, preferably shown in table IB, application no. 5, columns 5 and 7, or a portion thereof and encodes a protein having above-mentioned activity, e.g. conferring of a arginine, glutamate, glutamine and/or proline increase by for example expression either in the cytsol or in an organelle such as a plastid or mitochondria or both, preferably in plastids, and optionally, the activity of a protein as shown in table II, application no. 5, column 3.

Moreover, the nucleic acid molecule of the invention can comprise only a portion of the coding region of one of the sequences shown in table I, application no. 5, columns 5 and 7, preferably shown in table IB, application no. 5, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 5, columns 5 and 7, preferably shown in table IB, application no. 5, columns 5 and 7, an anti-sense sequence of one of the sequences, e.g., set forth in table I, application no. 5, columns 5 and 7, preferably shown in table IB, application no. 5, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 5, column 7 will result in a fragment of the gene product as shown in table II, column 3.

for the disclosure of this paragraph see paragraph [0164.0.0.0] above. [0165.0.4.4] The nucleic acid molecule of the invention encodes a polypeptide or portion thereof which includes an amino acid sequence which is sufficiently homologous to the amino acid sequence shown in table II, application no. 5, columns 5 and 7 such that the protein or portion thereof maintains the ability to participate in the fine chemical production, in particular a arginine, glutamate, glutamine and/or proline increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 5, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 5, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.4] and [0169.0.0.4] see paragraphs [0168.0.0.0] to [0169.0.0.0] above.

The invention further relates to nucleic acid molecules that differ from one of the nucleotide sequences shown in table I, application no. 5, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 5, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 5, columns 5 and 7 or the functional homologues. In a still further embodiment, the nucleic acid molecule of the invention encodes a full length protein which is substantially homologous to an amino acid sequence shown in table II, application no. 5, columns 5 and 7 or the functional homologues. However, in a preferred embodiment, the nucleic acid molecule of the present invention does not consist of the sequence shown in table I, application no. 5, columns 5 and 7, preferably as indicated in table IA, application no. 5, columns 5 and 7. Preferably the nucleic acid molecule of the invention is a functional homologue or identical to a nucleic acid molecule indicated in table IB, application no. 5, columns 5 and 7.

for the disclosure of the paragraphs [0171.0.0.4] to [0173.0.0.4] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 5, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 5, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 5, columns 5 and 7.

for the disclosure of the paragraphs [0179.0.0.4] and [0180.0.0.4] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 5, columns 5 and 7, preferably shown in table IIA, application no. 5, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 5, columns 5 and 7, preferably shown in table IIA, application no. 5, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 5, columns 5 and 7, preferably shown in table IIA, application no. 5, columns 5 and 7, more preferably at least about 70% identical to one of the sequences shown in table II, application no. 5, columns 5 and 7, preferably shown in table IIA, application no. 5, columns 5 and 7, even more preferably at least about 80%, 90%, 95% homologous to the sequence shown in table II, application no. 5, columns 5 and 7, preferably shown in table IIA, application no. 5, columns 5 and 7, and most preferably at least about 96%, 97%, 98%, or 99% identical to the sequence shown in table II, application no. 5, columns 5 and 7, preferably shown in table IIA, application no. 5, columns 5 and 7.

for the disclosure of the paragraphs [0182.0.0.4] to [0188.0.0.4] see paragraphs [0182.0.0.0] to [0188.0.0.0] above.

Functional equivalents derived from one of the polypeptides as shown in table II, application no. 5, columns 5 and 7, preferably shown in table IIB, application no. 5, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 5, columns 5 and 7, preferably shown in table IIB, application no. 5, columns 5 and 7 resp., according to the invention and are distinguished by essentially the same properties as the polypeptide as shown in table II, application no. 5, columns 5 and 7, preferably shown in table IIB, application no. 5, columns 5 and 7.

Functional equivalents derived from the nucleic acid sequence as shown in table I, application no. 5, columns 5 and 7, preferably shown in table IB, application no. 5, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 5, columns 5 and 7, preferably shown in table IIB, application no. 5, columns 5 and 7 resp., according to the invention and encode polypeptides having essentially the same properties as the polypeptide as shown in table II, application no. 5, columns 5 and 7, preferably shown in table IIB, application no. 5, columns 5 and 7.

for the disclosure of this paragraph see paragraph [0191.0.0.0] above.

A nucleic acid molecule encoding an homologous to a protein sequence of table II, application no. 5, columns 5 and 7, preferably shown in table IIB, application no. 5, columns 5 and 7 resp., can be created by introducing one or more nucleotide substitutions, additions or deletions into a nucleotide sequence of the nucleic acid molecule of the present invention, in particular of table I, application no. 5, columns 5 and 7, preferably shown in table IB, application no. 5, columns 5 and 7 resp., such that one or more amino acid substitutions, additions or deletions are introduced into the encoded protein. Mutations can be introduced into the encoding sequences of table I, application no. 5, columns 5 and 7, preferably shown in table IB, application no. 5, columns 5 and 7 resp., by standard techniques, such as site-directed mutagenesis and PCR-mediated mutagenesis.

for the disclosure of the paragraphs [0193.0.0.4] to [0196.0.0.4] see paragraphs [0193.0.0.0] to [0196.0.0.0] above.

Homologues of the nucleic acid sequences used, with the sequence shown in table I, application no. 5, columns 5 and 7, preferably shown in table IB, application no. 5, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 5, columns 5 and 7, preferably shown in table IB, application no. 5, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 5, columns 5 and 7, preferably shown in table IB, application no. 5, columns 5 and 7. It is preferred that the nucleic acid molecule comprises as little as possible other nucleotides not shown in any one of table I, application no. 5, columns 5 and 7, preferably shown in table IB, application no. 5, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 5, columns 5 and 7, preferably shown in table IB, application no. 5, columns 5 and 7.

Also preferred is that the nucleic acid molecule used in the process of the invention encodes a polypeptide comprising the sequence shown in table II, application no. 5, columns 5 and 7, preferably shown in table IIB, application no. 5, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 5, columns 5 and 7, preferably shown in table IIB, application no. 5, columns 5 and 7.

In one embodiment, the nucleic acid molecule of the invention or used in the process encodes a polypeptide comprising the sequence shown in table II, application no. 5, columns 5 and 7, preferably shown in table IIB, application no. 5, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 5, columns 5 and 7, preferably shown in table IIB, application no. 5, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 5, columns 5 and 7 expressed under identical conditions.

Homologues of table I, application no. 5, columns 5 and 7 or of the derived sequences of table II, application no. 5, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.4] to [0215.0.0.4] see paragraphs [0203.0.0.0] to [0215.0.0.0] above.

Accordingly, in one embodiment, the invention relates to a nucleic acid molecule, which comprises a nucleic acid molecule selected from the group consisting of:
a) nucleic acid molecule encoding, preferably at least the mature form, of the polypeptide shown in table II, application no. 5, columns 5 and 7, preferably in Table IIB, application no. 5, columns 5 and 7; or a fragment thereof conferring an increase in the amount of the fine chemical in an organism or a part thereof
b) nucleic acid molecule comprising, preferably at least the mature form, of the nucleic acid molecule shown in table I, application no. 5, columns 5 and 7, preferably in Table IB, application no. 5, columns 5 and 7 or a fragment thereof conferring an increase in the amount of the fine chemical in an organism or a part thereof;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybridizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying a cDNA library or a genomic library using the primers in table III, application no. 5, column 7 and conferring an increase in the amount of the fine chemical in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising the consensus sequence shown in table IV, application no. 5, columns 7 and conferring an increase in the amount of the fine chemical in an organism or a part thereof;
k) nucleic acid molecule encoding the amino acid sequence of a polypeptide encoding a domaine of the polypeptide shown in table II, application no. 5, columns 5 and 7 and conferring an increase in the amount of the fine chemical in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 5, columns 5 and 7 or a nucleic acid molecule encoding, preferably at least the mature form of, the polypeptide shown in table II, application no. 5, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 5, columns 5 and 7 by one or more nucleotides. In one embodiment, the nucleic acid molecule of the invention does not consist of the sequence shown in table IA and/or IB, application no. 5, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 5, columns 5 and 7. In a further embodiment the nucleic acid molecule does not encode the polypeptide sequence shown in table IIA and/or IIB, application no. 5, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 5, columns 5 and 7 does not encode a protein of the sequence shown in table IIA and/or IIB, application no. 5, columns 5 and 7. Accordingly, in one embodiment, the protein encoded by a sequence of a nucleic acid according to (a) to (l) does not consist of the sequence shown in table IA and/or IB, application no. 5, columns 5 and 7. In a further embodiment, the protein of the present invention is at least 30% identical to protein sequence depicted in table IIA and/or IIB, application no. 5, columns 5 and 7 and less than 100%, preferably less than 99.999%, 99.99% or 99.9%, more preferably less than 99%, 985, 97%, 96% or 95% identical to the sequence shown in table IIA and/or IIB, application no. 5, columns 5 and 7.

for the disclosure of the paragraphs [0217.0.0.4] to [0226.0.0.4] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 5, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.4] to [0239.0.0.4] see paragraphs [0228.0.0.0] to [0239.0.0.0] above.

In addition to the sequence mentioned in table I, application no. 5, columns 5 and 7 or its derivatives, it is advantageous additionally to express and/or mutate further genes in the organisms. Especially advantageously, additionally at least one further gene of the amino acid biosynthetic pathway such as for L-lysine, L-threonine and/or L-methionine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the nucleic acids sequences of the invention containing the sequences shown in table I, application no. 5, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.0.4] to [0264.0.0.4] see paragraphs [0241.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 5, columns 5 and 7 and described herein to achieve an expression in one of said compartments or extracellular.

for the disclosure of the paragraphs [0266.0.0.4] to [0287.0.0.4] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 5, columns 5 and 7 or their homologs is functionally linked to a plastidial targeting sequence. A further preferred embodiment of the invention relates to a vector in which a nucleic acid sequence encoding one of the polypeptides shown in table II, application no. 5, columns 5 and 7 or their homologs is functionally linked to a regulatory sequences which permit the expression in plastids.

for the disclosure of the paragraphs [0289.0.0.4] to [0296.0.0.4] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0342, anti-b0855, anti-b1062, anti-b1184, anti-b1223, anti-b1556, anti-b1758, anti-b2040, anti-b3443, anti-b4072, anti-b4074, anti-b1264, anti-b1852, anti-b1907, anti-b2025, anti-b2818, anti-b2926, anti-b2965, anti-b4139, anti-YGR262C, anti-YHR202W, anti-YMR262W, anti-YPL162C, anti-YAL038W, anti-YBR001C, anti-YER024W, anti-YGR256W, anti-YGR289C, anti-YHR037W, anti-YKR043C, anti-YLR027C and/or anti-YNL241C protein antibody or an antibody against polypeptides as shown in table II, application no. 5, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 5, columns 5 and 7 or as coded by the nucleic acid molecule shown in table I, application no. 5, columns 5 and 7 or functional homologues thereof.

In one advantageous embodiment, in the method of the present invention the activity of a polypeptide is increased comprising or consisting of the consensus sequence shown in table IV, application no. 5, columns 7 and in one another embodiment, the present invention relates to a polypeptide comprising or consisting of the consensus sequence shown in table IV, application no. 5, columns 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.4] to [0304.0.0.4] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 5, columns 5 and 7 by one or more amino acids. In one embodiment, polypeptide distinguishes form the sequence shown in table II, application no. 5, columns 5 and 7 by more than 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from the sequence shown in table IIA and/or IIB, application no. 5, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 5, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 5, columns 5 and 7 by one or more amino acids. In another embodiment, said polypeptide of the invention does not consist of the sequence shown in table IIA and/or IIB, application no. 5, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 5, columns 5 and 7.

In one embodiment, the present invention relates to a polypeptide having the activity of the protein as shown in table IIA and/or IIB, application no. 5, column 3, which distinguishes over the sequence depicted in table IIA and/or IIB, application no. 5, columns 5 and 7 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.4] to [0311.0.0.4] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table IIA and/or IIB, application no. 5, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 5, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 5, columns 5 and 7 or which is homologous thereto, as defined above.

Accordingly the polypeptide of the present invention can vary from the sequences shown in table IIA and/or IIB, application no. 5, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 5, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 5, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 5, column 3. Differences shall mean at least one amino acid different from the sequences as shown in table II, application no. 5, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 5, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 5, column 3. The nucleic acid molecules and polypeptide molecules of the invention are expressed such that the yield, production, and/or efficiency of production of a desired compound is improved.

for the disclosure of the paragraphs [0320.0.0.4] to [0322.0.0.4] see paragraphs [0320.0.0.0] to [0322.0.0.0] above.

In one embodiment, a protein (=polypeptide) as shown in table II, application no. 5, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 5, column 3, e.g., a protein which does not confer the activity described herein and which is derived from the same or a different organism.

for the disclosure of the paragraphs [0324.0.0.4] to [0329.0.0.4] see paragraphs [0324.0.0.0] to [0329.0.0.0] above.

In an especially preferred embodiment, the polypeptide according to the invention furthermore also does not have the sequences of those proteins which are encoded by the sequences shown in table II, application no. 5, columns 5 and 7.

for the disclosure of the paragraphs [0331.0.0.4] to [0346.0.0.4] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 5, column 3. Due to the above mentioned activity the fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 5, column 3 or a protein as shown in table II, application no. 5, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 5, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.4] to [0369.0.0.4] see paragraphs [0350.0.0.0] to [0369.0.0.0] above.

The fermentation broths obtained in this way, containing in particular L-arginine, L-glutamate, L-glutamine and/or L-proline preferably L-arginine, L-glutamine and/or L-proline, normally have a dry matter content of from 7.5 to 25% by weight. The fermentation broth can be processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

for the disclosure of the paragraphs [0371.0.0.4] to [0376.0.0.4], [0376.1.0.4] and [0377.0.0.4] see paragraphs [0371.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 5, columns 5 and 7, preferably in table IB, application no. 5, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.4] to [0383.0.0.4] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 5, column 3, e.g. comparing near identical organisms with low and high activity of the proteins as shown in table II, application no. 5, column 3.

for the disclosure of the paragraphs [0385.0.0.4] to [0435.0.0.4] see paragraphs [0385.0.0.0] to [0435.0.0.0] above.

Arginine, glutamate, glutamine and/or proline production in *Chlamydomonas reinhardtii*

The amino acid production can be analysed as mentioned above. The proteins and nucleic acids can be analysed as mentioned below.

for the disclosure of the paragraphs [0437.0.0.4] to [0497.0.0.4] see paragraphs [0437.0.0.0] to [0497.0.0.0] above.

The results of the different plant analyses can be seen from the table, which follows:

TABLE VI

| ORF | Metabolite | Method | Min | Max |
|---|---|---|---|---|
| b1264 | Glutamine | LC | 1.27 | 1.75 |
| b1852 | Proline | GC + LC | 1.45 | 1.62 |
| b1907 | Arginine | LC | 1.46 | 2.13 |
| b2025 | Proline | GC | 1.38 | 4.53 |
| b2818 | Arginine | LC | 4.33 | 14.36 |
| b2926 | Proline | GC | 1.34 | 2.30 |
| b2965 | Proline | GC + LC | 1.60 | 9.55 |
| b4139 | Glutamine | LC | 1.38 | 2.00 |
| YAL038W | Proline | GC | 1.41 | 2.01 |
| YAL038W | Glutamate | GC | 1.58 | 2.20 |
| YBR001C | Proline | GC + LC | 1.33 | 1.66 |
| YER024W | Arginine | LC | 1.24 | 1.39 |
| YGR256W | Proline | LC | 1.54 | 2.22 |
| YGR289C | Proline | GC | 1.37 | 1.82 |
| YHR037W | Proline | GC + LC | 1.71 | 2.17 |
| YKR043C | Proline | GC + LC | 1.34 | 4.30 |
| YLR027C | Proline | LC | 1.52 | 2.82 |
| YNL241C | Arginine | LC | 1.48 | 3.74 |
| b0342 | Glutamine | LC | 1.29 | 1.81 |
| b0342 | Glutamate | LC | 1.33 | 1.85 |
| b0855 | Arginine | LC | 1.46 | 2.13 |
| b1062 | Proline | GC | 1.43 | 2.45 |
| b1184 | Proline | GC | 1.34 | 2.30 |
| b1223 | Proline | GC | 1.44 | 6.01 |
| b1556 | Proline | GC | 1.45 | 3.29 |
| b1758 | Glutamate | LC | 1.36 | 1.38 |
| b2040 | Glutamine | LC | 1.32 | 1.49 |
| b3443 | Glutamine | LC | 1.30 | 1.36 |
| b4072 | Glutamine | LC | 1.33 | 1.45 |
| b4074 | Proline | LC | 1.45 | 1.62 |
| b4139 | Arginine | LC | 2.06 | 11.38 |
| YGR262C | Glutamate | LC | 1.33 | 1.48 |
| YHR202W | Glutamate | LC | 1.33 | 1.34 |
| YMR262W | Glutamate | LC | 1.35 | 2.28 |
| YPL162C | Glutamine | LC | 1.28 | 1.59 | for the disclosure of the paragraphs [0499.0.0.4] and [0500.0.0.4] see paragraphs [0499.0.0.0] and [0500.0.0.0] above.

Example 15a

Engineering Ryegrass Plants by Over-expressing YAL038W from *Saccharomyces cerevisiae* or Homologs of YAL038W from Other Organisms for the disclosure of the paragraphs [0502.0.0.4] to [0508.0.0.4] see paragraphs [0502.0.0.0] to [0508.0.0.0] above.

Example 15b

Engineering Soybean Plants by Over-expressing YAL038W from *Saccharomyces cerevisiae* or Homologs of YAL038W from Other Organisms for the disclosure of the paragraphs [0510.0.0.4] to [0513.0.0.4] see paragraphs [0510.0.0.0] to [0513.0.0.0] above.

Example 15c

Engineering Corn Plants by Over-expressing YAL038W from *Saccharomyces cerevisiae* or Homologs of YAL038W from Other Organisms for the disclosure of the paragraphs [0515.0.0.4] to [0540.0.0.4] see paragraphs [0515.0.0.0] to [0540.0.0.0] above.

Example 15d

Engineering Wheat Plants by Over-expressing YAL038W from *Saccharomyces cerevisiae* or Homologs of YAL038W from Other Organisms for the disclosure of the paragraphs [0542.0.0.4] to [0544.0.0.4] see paragraphs [0542.0.0.0] to [0544.0.0.0] above.

Example 15e

Engineering Rapeseed/Canola Plants by Over-expressing YAL038W from *Saccharomyces cerevisiae* or Homologs of YAL038W from Other Organisms for the disclosure of the paragraphs [0546.0.0.4] to [0549.0.0.4] see paragraphs [0544.0.0.0] to [0549.0.0.0] above.

Example 15f

Engineering Alfalfa Plants by Over-expressing YAL038W from *Saccharomyces cerevisiae* or Homologs of YAL038W from Other Organisms for the disclosure of the paragraphs [0551.0.0.4] to [0554.0.0.4] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII as minimal (MIN) or maximal changes (MAX) in the respective fine chemical (column "metabolite") in genetically modified corn plants expressing the sequence listed in column 1 (ORF): The results of the different Zea mays plants analysed can be seen from table VII, which follows:

TABLE VII

| ORF_NAME | Metabolite | Min | Max |
|---|---|---|---|
| b2818 | Arginine | 5.47 | 12.62 |
| b4139 | Arginine | 2.32 | 2.46 |
| b4139 | Glutamine | 1.37 | 4.47 |
| YAL038W | Proline | 1.51 | 4.48 |
| YKR043C | Proline | 2.03 | 2.61 |
| YLR027C | Proline | 1.44 | 2.41 |

Table VII shows the increase in arginine or proline in genetically modified corn plants expressing the Escherichia coli sequences b2818 or b4139 or the Saccharomyces cerevisiae nucleic acid sequence YAL038W, YKR043C or YLR027C.

In one embodiment, in case the activity of the Saccaromyces cerevisiae protein YAL038W or its homologs, e.g. a "pyruvate kinase", is increased in corn plants, preferably, an increase of the fine chemical proline between 51% and 338% or more is conferred.

In one embodiment, in case the activity of the Saccaromyces cerevisiae protein YKR043C or its homologs, e.g. a "phosphoglycerate mutase like protein", is increased in corn plants, preferably, an increase of the fine chemical proline between 103% and 161% or more is conferred.

In one embodiment, in case the activity of the Saccaromyces cerevisiae protein YLR027C or its homologs, e.g. a "aspartate aminotransferase", is increased in corn plants, preferably, an increase of the fine chemical proline between 103% and 161% or more is conferred.

In one embodiment, in case the activity of the Escherichia coli protein b2818 or its homologs, e.g. a "N-acetylglutamate synthase", is increased in corn plants, preferably, an increase of the fine chemical proline between 447% and 1162% or more is conferred.

In one embodiment, in case the activity of the Escherichia coli protein b4139 or its homologs, e.g. a "aspartate ammonia-lyase (aspartase)", is increased in corn plants, preferably, an increase of the fine chemical arginine between 132% and 146% or more is conferred.

In one embodiment, in case the activity of the Escherichia coli protein b4139 or its homologs, e.g. a "aspartate ammonia-lyase (aspartase)", is increased in corn plants, preferably, an increase of the fine chemical glutamine between 37% and 347% or more is conferred.

In one embodiment, in case the activity of the Escherichia coli protein b4139 or its homologs, e.g. a "aspartate ammonia-lyase (aspartase)", is increased in corn plants, preferably, an increase of the fine chemical glutamine between 37% and 347% or more and of the fine chemical arginine between 132% and 146% or more is conferred.

for the disclosure of this paragraph see [0554.2.0.0] above.
for the disclosure of this paragraph see [0555.0.0.0] above.
for the disclosure of this paragraph see [0001.0.0.0].

Fatty acids are the building blocks of triglycerides, lipids, oils and fats. Some of the fatty acids such as linoleic or linolenic acid are "essential" because the human body is not able to synthesize them but needs them, so humans must ingest them through the diet. The human body can synthesize other fatty acids therefore they are not labeled as "essential". Nevertheless very often the amount of production of for example fatty acids such as eicosapentaenoic acid (=EPA, $C_{20:5}^{\Delta 5,8,11,14,17}$) or docosahexaenoic acid acid (=DHA, $C_{22:6}^{\Delta 4,7,10,13,16,19}$) in the body is not sufficient for an optimal body function. Polyunsaturated fatty acids (=PUFA) that mean fatty acids, which have more than 1 double bond in the carbon chain are divided into families depending on where their end-most double bond is located. There are two main subtypes of fatty acids: the omega-3 and omega-6 fatty acids. The Omega-3's are those with their endmost double bond 3 carbons from their methyl end. The Omega-6's are those with their endmost double bond 6 carbons from their methyl end. Linoleic acid (an omega-6) and alpha-linolenic acid (an omega-3) are the only true "essential" fatty acids. Both are used inside the body as starting material to synthesize others such as EPA or DHA.

Fatty acids and triglycerides have numerous applications in the food and feed industry, in cosmetics and in the drug sector. Depending on whether they are free saturated or unsaturated fatty acids or triglycerides with an increased content of saturated or unsaturated fatty acids, they are suitable for the most varied applications; thus, for example, polyunsaturated fatty acids (=PUFAs) are added to infant formula to increase its nutritional value. The various fatty acids and triglycerides are mainly obtained from microorganisms such as fungi or from oil-producing plants including phytoplankton and algae, such as soybean, oilseed rape, sunflower and others, where they are usually obtained in the form of their triacylglycerides.

Principally microorganisms such as Mortierella or oil producing plants such as soybean, rapeseed or sunflower or algae such as Crytocodinium or Phaeodactylum are a common source for oils containing PUFAs, where they are usually obtained in the form of their triacyl glycerides. Alternatively, they are obtained advantageously from animals, such as fish. The free fatty acids are prepared advantageously by hydrolysis with a strong base such as potassium or sodium hydroxide. Higher poly unsaturated fatty acids such as DHA, EPA, ARA, Dihomo-γ-linoleic acid ($C_{20:3}^{\Delta 8,11,14}$) or Docosapentaenoic acid (=DPA, $C_{22:5}^{\Delta 7,10,13,16,19}$) are not produced by oil producing plants such as soybean, rapeseed, safflower or sunflower. A natural sources for said fatty acids are fish for example herring, salmon, sardine, redfish, eel, carp, trout, halibut, mackerel, pike-perch or tuna or algae.

Whether oils with unsaturated or with saturated fatty acids are preferred depends on the intended purpose; thus, for example, lipids with unsaturated fatty acids, specifically polyunsaturated fatty acids, are preferred in human nutrition since they have a positive effect on the cholesterol level in the blood and thus on the possibility of heart disease. They are used in a variety of dietetic foodstuffs or medicaments. In addition PUFAs are commonly used in food, feed and in the cosmetic industry. Poly unsaturated ω-3- and/or ω-6-fatty acids are an important part of animal feed and human food. Because of the common composition of human food polyunsaturated ω-3-fatty acids, which are an essential component of fish oil, should be added to the food to increase the nutritional value of the food; thus, for example, polyunsaturated fatty acids such as DHA or EPA are added as mentioned above to infant formula to increase its nutritional value. The true essential fatty acids linoleic and linolenic fatty acid have a lot of positive effects in the human body such as a positive effect on healthy heart, arteries and skin. They bring for example relieve from eczema, diabetic neuropathy or PMS and cyclical breast pain.

Poly unsaturated ω-3- and ω-6-fatty acids are for example precursor of a family of paracrine hormones called eicosanoids such as prostaglandins which are products of the metabolism of Dihomo-γ-linoleic acid, ARA or EPA. Eicosanoids are involved in the regulation of lipolysis, the initiation of inflammatory responses, the regulation of blood circulation and pressure and other central functions of the body. Eicosanoids comprise prostaglandins, leukotrienes, thromboxanes, and prostacyclins. ω-3-fatty acids seem to prevent artherosclerosis and cardiovascular diseases primarily by regulating the levels of different eicosanoids. Other Eicosanoids are the thromboxanes and leukotrienes, which are products of the metabolism of ARA or EPA.

On account of their positive properties there has been no shortage of attempts in the past to make available genes which participate in the synthesis of fatty acids or triglycerides for the production of oils in various organisms having a modified content of unsaturated fatty acids.

Methods of recombinant DNA technology have also been used for some years to improve the oil content in microorganisms or plants by amplifying individual fatty acid biosynthesis genes and investigating the effect on fatty acid production. For example in WO 91/13972 a Δ-9-desaturase is described, which is involved in the synthesis of polyunsaturated fatty acids. In WO 93/11245 a Δ-15-desaturase and in WO 94/11516 a Δ-12-desaturase is claimed. Other desaturases are described, for example, in EP-A-0 550 162, WO 94/18337, WO 97/30582, WO 97/21340, WO 95/18222, EP-A-0 794 250, Stukey et al., J. Biol. Chem., 265, 1990: 20144-20149, Wada et al., Nature 347, 1990: 200-203 or Huang et al., Lipids 34, 1999: 649-659. To date, however, the various desaturases have been only inadequately characterized biochemically since the enzymes in the form of membrane-bound proteins are isolable and characterizable only with very great difficulty (McKeon et al., Methods in Enzymol. 71, 1981: 12141-12147, Wang et al., Plant Physiol. Biochem., 26, 1988: 777-792). Generally, membrane-bound desaturases are characterized by introduction into a suitable organism, which is then investigated for enzyme activity by means of analysis of starting materials and products. With regard to the effectiveness of the expression of desaturases and their effect on the formation of polyunsaturated fatty acids it may be noted that through expression of a desaturases and elongases as described to date only low contents of poly-unsaturated fatty acids/lipids have been achieved. Therefore, an alternative and more effective pathway with higher product yield is desirable.

As described above, the essential fatty acids are necessary for humans and many mammals, for example for livestock. In a study of middle-aged men disclosed by Finnish researchers (International Journal of Cancer, Sep. 1, 2004), high intake of linoleic acid seemed to lower the risk of prostate and other cancers. In another publication the positive influence on stroke is disclosed (Umemura et al., Stroke, 2002, vol. 33, pp. 2086-2093).

Therefore improving the quality of foodstuffs and animal feeds is an important task of the food-and-feed industry. This is necessary since, for example, as mentioned above certain fatty acids, which occur in plants are limited with regard to the supply of mammals. Especially advantageous for the quality of foodstuffs and animal feeds is as balanced as possible fatty acid profile in the diet since a great excess of omega-3-fatty acids above a specific concentration in the food has no positive effect unless the omega-3-fatty acid content is in balance to the omega-6-fatty acid content of the diet. A further increase in quality is only possible via addition of further fatty acids, which are limiting under these conditions. The targeted addition of the limiting fatty acid in the form of synthetic products must be carried out with extreme caution in order to avoid fatty acid imbalance.

To ensure a high quality of foods and animal feeds, it is therefore necessary to add a plurality of fatty acids in a balanced manner to suit the organism.

Accordingly, there is still a great demand for new and more suitable genes which encode proteins which participate in the biosynthesis of fatty acids and make it possible to produce certain fatty acids specifically on an industrial scale without unwanted byproducts forming. In the selection of genes for biosynthesis two characteristics above all are particularly important. On the one hand, there is as ever a need for improved processes for obtaining the highest possible contents of polyunsaturated fatty acids on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is linoleic acid or triglycerides, lipids, oils or fats containing linoleic acid. Accordingly, in the present invention, the term "the fine chemical" as used herein relates to "linoleic acid and/or triglycerides, lipids, oils and/or fats containing linoleic acid". Further, the term "the fine chemicals" as used herein also relates to fine chemicals comprising linoleic acid and/or triglycerides, lipids, oils and/or fats containing linoleic acid.

In one embodiment, the term "the fine chemical" or "the respective fine chemical" means linoleic acid and/or triglycerides, lipids, oils and/or fats containing linoleic acid. Throughout the specification the term "the fine chemical" or "the respective fine chemical" means linoleic acid and/or triglycerides, lipids, oils and/or fats containing linoleic acid, linoleic acid and its salts, ester, thioester or linoleic acid in free form or bound to other compounds such as triglycerides, glycolipids, phospholipids etc. In a preferred embodiment, the term "the fine chemical" means linoleic acid, in free form or its salts or bound to triglycerides. Triglycerides, lipids, oils, fats or lipid mixture thereof shall mean any triglyceride, lipid, oil and/or fat containing any bound or free linoleic acid for example sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, or as monoacylglyceride, diacylglyceride or triacylglyceride or other fatty acid esters such as acetyl-Coenzym A thioester, which contain further saturated or unsaturated fatty acids in the fatty acid molecule.

In one embodiment, the term "the fine chemical" and the term "the respective fine chemical" mean at least one chemical compound with an activity of the abovementioned fine chemical.

Accordingly, the present invention relates to a process for the production of linoleic acid, which comprises
(a) increasing or generating the activity of a protein as shown in table II, application no. 6, column 3 encoded by the nucleic acid sequences as shown in table I, application no. 6, column 5, in an organelle of a microorganism or plant, or
(b) increasing or generating the activity of a protein as shown in table II, application no. 6, column 3 encoded by the nucleic acid sequences as shown in table I, application no. 6, column 5 in the plastid of a microorganism or plant, or in one or more parts thereof; and
(c) growing the organism under conditions which permit the production of the fine chemical, thus, linoleic acid or fine chemicals comprising linoleic acid, in said organism or in the culture medium surrounding the organism.

In another embodiment the present invention is related to a process for the production of linoleic acid, which comprises
(a) increasing or generating the activity of a protein as shown in table II, application no. 6 column 3 encoded by the nucleic acid sequences as shown in table I, application no. 6, column 5, in an organelle of a non-human organism, or
(b) increasing or generating the activity of a protein as shown in table II, application no. 6, column 3 encoded by the nucleic acid sequences as shown in table I, application no. 6, column 5, which are joined to a nucleic acid sequence encoding a transit peptide in a non-human organism, or in one or more parts thereof; or
(c) increasing or generating the activity of a protein as shown in table II, application no. 6, column 3 encoded by the nucleic acid sequences as shown in table I, application no. 6, column 5, which are joined to a nucleic acid sequence encoding chloroplast localization sequence, in a non-human organism, or in one or more parts thereof, and
(d) growing the organism under conditions which permit the production of linoleic acid in said organism.

In another embodiment, the present invention relates to a process for the production of linoleic acid, which comprises
(a) increasing or generating the activity of a protein as shown in table II, application no. 6, column 3 encoded by the nucleic acid sequences as shown in table I, application no. 6, column 5, in an organelle of a microorganism or plant through the transformation of the organelle, or
(b) increasing or generating the activity of a protein as shown in table II, application no. 6, column 3 encoded by the nucleic acid sequences as shown in table I, application no. 6, column 5 in the plastid of a microorganism or plant, or in one or more parts thereof through the transformation of the plastids; and
(c) growing the organism under conditions which permit the production of the fine chemical, thus, linoleic acid or fine chemicals comprising linoleic acid, in said organism or in the culture medium surrounding the organism.

Advantagously the activity of the protein as shown in table II, application no. 6, column 3 encoded by the nucleic acid sequences as shown in table I, application no. 6, column 5 is increased or generated in the abovementioned process in the plastid of a microorganism or plant.

for the disclosure of the paragraphs [0019.0.0.5] to [0024.0.0.5] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 6, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-transitionally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 6, column 3 and its homologs as disclosed in table I, application no. 6, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 6, column 3 and its homologs as disclosed in table I, application no. 6, columns 5 and 7.

for the disclosure of the paragraphs [0027.0.0.5] to [0029.0.0.5] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 6, columns 5 and 7. The person skilled in the art is able to join said sequences in a functional manner. Advantageously the transit peptide part is cleaved off from the protein part shown in table II, application no. 6, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 6, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 6, columns 5 and 7. In case of the amino acid sequence QIA CSS the three amino acids in front of the start methionine are stemming from the LIC (=ligation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 6, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 6, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 6, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.5] and [0030.3.0.5] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 6, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 6, columns 5 and 7 or a sequence encoding a protein, as depicted in table II, application no. 6, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 6, columns 5 and 7 or a sequence encoding a protein, as depicted in table II, application no. 6, columns 5 and 7 in such a manner that the viroid sequence transports a sequence transcribed from a sequence as depicted in table I, application no. 6, columns 5 and 7 or a sequence encoding a protein as depicted in table II, application no. 6, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 6, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 6, columns 5 and 7.

In a preferred embodiment of the invention the nucleic acid sequences as shown in table I, application no. 6, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 6, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.5] and [0032.0.0.5] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 6, column 3. Preferably the modification of the activity of a protein as shown in table II, application no. 6, column 3 or their combination can be achieved by joining the protein to a transit peptide.

Surprisingly it was found, that the transgenic expression of the *Saccaromyces cerevisiae* protein as shown in table II, application no. 6, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b0403 (Accession number PIR:C64769) from *Escherichia coli* has been published in Blattner et al., Science 277 (5331), 1453-1474 (1997), and its activity is being defined as "maltodextrin glucosidase". Accordingly, in one embodiment, the process of the present invention comprises the use of a "maltodextrin glucosidase" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a b0403 protein is increased or generated, e.g. from *Escherichia coli* or a homolog thereof, preferably linked at least to one transit peptide as mentioned for example in table V.

In another embodiment, in the process of the present invention the activity of a b0403 protein is increased or generated in a subcellular compartment of the organism or organism cell such as in an organelle like a plastid or mitochondria.

The sequence of b0931 (Accession number PIR:JQ0756) from *Escherichia coli* has been published in Blattner et al., Science 277 (5331), 1453-1474 (1997), and its activity is being defined as "nicotinate phosphoribosyltransferase". Accordingly, in one embodiment, the process of the present invention comprises the use of a "nicotinate phosphoribosyltransferase" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a b0931 protein is increased or generated, e.g. from *Escherichia coli* or a homolog thereof, preferably linked at least to one transit peptide as mentioned for example in table V.

In another embodiment, in the process of the present invention the activity of a b0931 protein is increased or generated in a subcellular compartment of the organism or organism cell such as in an organelle like a plastid or mitochondria.

The sequence of b1046 (Accession number PIR:C64847) from *Escherichia coli* has been published in Blattner et al., Science 277 (5331), 1453-1474 (1997), and its activity is being defined as "putative synthase with phospholipase D/nuclease domain". Accordingly, in one embodiment, the process of the present invention comprises the use of a "putative synthase with phospholipase D/nuclease domain" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a b1046 protein is increased or generated, e.g. from *Escherichia coli* or a homolog thereof, preferably linked at least to one transit peptide as mentioned for example in table V.

In another embodiment, in the process of the present invention the activity of a b1046 protein is increased or generated in a subcellular compartment of the organism or organism cell such as in an organelle like a plastid or mitochondria.

The sequence of b1933 (Accession number PIR:B64957) from *Escherichia coli* has been published in Blattner et al., Science 277 (5331), 1453-1474 (1997), and its activity has not been characterized. Accordingly, in one embodiment, the process of the present invention comprises the use of a "b1933 protein" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a b1933 protein is increased or generated, e.g. from *Escherichia coli* or a homolog thereof, preferably linked at least to one transit peptide as mentioned for example in table V.

In another embodiment, in the process of the present invention the activity of a b1933 protein is increased or generated in a subcellular compartment of the organism or organism cell such as in an organelle like a plastid or mitochondria.

The sequence of b2126 (Accession number PIR:E64980) from *Escherichia coli* has been published in Blattner et al., Science 277 (5331), 1453-1474 (1997), and its activity is being defined as "putative sensory kinase in a two component regulatory system". Accordingly, in one embodiment, the process of the present invention comprises the use of a "putative sensory kinase" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a b2126 protein is increased or generated, e.g. from *Escherichia coli* or a homolog thereof, preferably linked at least to one transit peptide as mentioned for example in table V.

In another embodiment, in the process of the present invention the activity of a b2126 protein is increased or generated in a subcellular compartment of the organism or organism cell such as in an organelle like a plastid or mitochondria.

The sequence of b3708 (Accession number PIR:WZEC) from *Escherichia coli* has been published in Blattner et al., Science 277 (5331), 1453-1474 (1997), and its activity is being defined as "tryptophan deaminase PLP dependent". Accordingly, in one embodiment, the process of the present invention comprises the use of a "tryptophan deaminase" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a b3708 protein is increased or generated, e.g. from *Escherichia coli* or a homolog thereof, preferably linked at least to one transit peptide as mentioned for example in table V.

In another embodiment, in the process of the present invention the activity of a b3708 protein is increased or generated in a subcellular compartment of the organism or organism cell such as in an organelle like a plastid or mitochondria.

The sequence of b3728 (Accession number PIR: BYECPR) from *Escherichia coli* has been published in Blattner et al., Science 277 (5331), 1453-1474 (1997), and its activity is being defined as "high affinity phosphate transport protein (ABC superfamily peri bind)". Accordingly, in one embodiment, the process of the present invention comprises the use of a "high affinity phosphate transport protein" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a b3728 protein is increased or generated, e.g. from *Escherichia coli* or a homolog thereof, preferably linked at least to one transit peptide as mentioned for example in table V.

In another embodiment, in the process of the present invention the activity of a b3728 protein is increased or generated in a subcellular compartment of the organism or organism cell such as in an organelle like a plastid or mitochondria.

The sequence of YNR012W (Accession number NP_014409) from *Saccharomyces cerevisiae* has been published in Goffeau et al., Science 274 (5287), 546-547,1996, and its activity is being defined as "uridine kinase". Accordingly, in one embodiment, the process of the present invention comprises the use of a "uridine kinase" or its homolog, e.g. as shown herein, for the production of the fine chemical, meaning of linoleic acid and/or triglycerides, lipids, oils and/or fats containing linoleic acid, in particular for increasing the amount of linoleic acid in free or bound form in an organism or a part thereof, as mentioned. In one embodiment, in the process of the present invention the activity of a YNR012W protein is increased or generated, e.g. from *Saccharomyces cerevisiae* or a homolog thereof, preferably linked at least to one transit peptide as mentioned for example in table V.

In another embodiment, in the process of the present invention the activity of an YNR012W protein is increased or generated in a subcellular compartment of the organism or organism cell such as in an organelle like a plastid or mitochondria.

In one embodiment, the homolog of the YNR012W, is a homolog having said activity and being derived from Eukaryot. In one embodiment, the homolog of the b0403, b0931, b1046, b1933, b2126, b3708 and/or b3728 is a homolog having said activity and being derived from bacteria. In one embodiment, the homolog of the YNR012W is a homolog having said activity and being derived from Fungi. In one embodiment, the homolog of the b0403, b0931, b1046, b1933, b2126, b3708 and/or b3728 is a homolog having said activity and being derived from Proteobacteria. In one embodiment, the homolog of the YNR012W is a homolog having said activity and being derived from Ascomycota. In one embodiment, the homolog of the b0403, b0931, b1046, b1933, b2126, b3708 and/or b3728 is a homolog having said activity and being derived from Gammaproteobacteria. In one embodiment, the homolog of the YNR012W is a homolog having said activity and being derived from *Saccharomycotina*. In one embodiment, the homolog of the b0403, b0931, b1046, b1933, b2126, b3708 and/or b3728 is a homolog having said activity and being derived from Enterobacteriales. In one embodiment, the homolog of the YNR012W is a homolog having said activity and being derived from *Saccharomycetes*. In one embodiment, the homolog of the b0403, b0931, b1046, b1933, b2126, b3708 and/or b3728 is a homolog having said activity and being derived from Enterobacteriaceae. In one embodiment, the homolog of the YNR012W is a homolog having said activity and being derived from *Saccharomycetales*. In one embodiment, the homolog of the b0403, b0931, b1046, b1933, b2126, b3708 and/or b3728 is a homolog having said activity and being derived from *Escherichia*, preferably from *Escherichia coli*. In one embodiment, the homolog of the YNR012W is a homolog having said activity and being derived from Saccharomycetaceae. In one embodiment, the homolog of the YNR012W is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 6, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 6, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 6, column 3, or which has at least 10% of the original enzymatic activity, preferably 20%, particularly preferably 30%, most particularly preferably 40% in comparison to a protein as shown in table II, application no. 6, column 3 of *Saccharomyces cerevisiae*.

for the disclosure of the paragraphs [0040.0.0.5] to [0047.0.0.5] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 6, column 3 its biochemical or genetical causes and the increased amount of the fine chemical.

for the disclosure of the paragraphs [0049.0.0.5] to [0051.0.0.5] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 6, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.5] to [0058.0.0.5] see paragraphs [0053.0.0.0] to [0058.0.0.0] above.

In case the activity of the *Escherichia coli* protein b0403 or its homologs, e.g. a "maltodextrin glucosidase" is increased advantageously in an organelle such as a plastid or mitochondria, preferably, in one embodiment an increase of the fine chemical, preferably of linoleic acid and/or triglycerides, lipids, oils and/or fats containing linoleic acid between 15% and 38% or more is conferred.

In case the activity of the *Escherichia coli* protein b0931 or its homologs, e.g. a "nicotinate phosphoribosyltransferase" is increased advantageously in an organelle such as a plastid or mitochondria, preferably, in one embodiment an increase of the fine chemical, preferably of linoleic acid and/or triglycerides, lipids, oils and/or fats containing linoleic acid between 16% and 45% or more is conferred.

In case the activity of the *Escherichia coli* protein b1046 or its homologs, e.g. a "putative synthase with phospholipase D/nuclease domain" is increased advantageously in an organelle such as a plastid or mitochondria, preferably, in one embodiment an increase of the fine chemical, preferably of linoleic acid and/or triglycerides, lipids, oils and/or fats containing linoleic acid between 15% and 22% or more is conferred.

In case the activity of the *Escherichia coli* protein b1933 or its homologs, e.g. a "b1933 protein with unknown biological function" is increased advantageously in an organelle such as a plastid or mitochondria, preferably, in one embodiment an increase of the fine chemical, preferably of linoleic acid and/or triglycerides, lipids, oils and/or fats containing linoleic acid between 14% and 22% or more is conferred.

In case the activity of the *Escherichia coli* protein b2126 or its homologs, e.g. a "putative sensory kinase in a two component regulatory system" is increased advantageously in an organelle such as a plastid or mitochondria, preferably, in one embodiment an increase of the fine chemical, preferably of linoleic acid and/or triglycerides, lipids, oils and/or fats containing linoleic acid between 14% and 24% or more is conferred.

In case the activity of the *Escherichia coli* protein b3708 or its homologs, e.g. a "tryptophan deaminase PLP dependent" is increased advantageously in an organelle such as a plastid or mitochondria, preferably, in one embodiment an increase of the fine chemical, preferably of linoleic acid and/or triglycerides, lipids, oils and/or fats containing linoleic acid between 15% and 39% or more is conferred.

In case the activity of the *Escherichia coli* protein b3728 or its homologs, e.g. a "high affinity phosphate transport protein (ABC superfamily peri bind)" is increased advantageously in an organelle such as a plastid or mitochondria, preferably, in one embodiment an increase of the fine chemical, preferably of linoleic acid and/or triglycerides, lipids, oils and/or fats containing linoleic acid between 15% and 21% or more is conferred.

In case the activity of the *Saccharomyces cerevisiae* protein YNR012W or its homologs, e.g. a "uridine kinase" is increased advantageously in an organelle such as a plastid or mitochondria, preferably, in one embodiment an increase of the fine chemical, preferably of linoleic acid and/or triglycerides, lipids, oils and/or fats containing linoleic acid between 15% and 21% or more is conferred.

In case the activity of the *Escherichia coli* proteins b0403, b0931, b1046, b1933, b2126, b3708 or b3728 or their homologs," are increased advantageously in an organelle such as a plastid or mitochondria, preferably an increase of the fine chemical linoleic acid and/or triglycerides, lipids, oils and/or fats containing linoleic acid is conferred.

In case the activity of the *Saccharomyces cerevisiae* protein YNR012W or its homologs, e.g. a "uridine kinase" is increased advantageously in an organelle such as a plastid or mitochondria, preferably an increase of the fine chemical linoleic acid and/or triglycerides, lipids, oils and/or fats containing linoleic acid is conferred.

for the disclosure of the paragraphs [0061.0.0.5] and [0062.0.0.5] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 6, column 7 or of the polypeptide as shown in the amino acid sequences as disclosed in table II, application no. 6, columns 5 and 7 or the functional homologues thereof as described herein, or is encoded by the nucleic acid molecule characterized herein or the nucleic acid molecule according to the invention, for example by the nucleic acid molecule as shown in table I, application no. 6, columns 5 and 7 or its herein described functional homologues and has the herein mentioned activity.

For the purposes of the present invention, the term "linoleic acid" also encompasses the corresponding salts, such as, for example, the potassium or sodium salts of linoleic acid or the salts of linoleic acid with amines such as diethylamine as well as triglycerides, lipids, oils and/or fats containing linoleic acid.

for the disclosure of the paragraphs [0065.0.0.5] and [0066.0.0.5] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 6, columns 5 and 7 or its homologs activity having herein-mentioned linoleic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 6, columns 5 and 7, e.g. a nucleic acid sequence encoding a polypeptide having the activity of a protein as indicated in table II, application no. 6, columns 5 and 7 or its homologs activity or of a mRNA encoding the polypeptide of the present invention having herein-mentioned linoleic acid increasing activity; and/or c) increasing the specific activity of a protein conferring the increased expression of a protein encoded by the nucleic acid molecule of the invention or of the polypeptide of the present invention having herein-mentioned linoleic acid increasing activity, e.g. of a polypeptide having the activity of a protein as indicated in table II, application no. 6, columns 5 and 7 or its homologs activity, or decreasing the inhibitiory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned linoleic acid increasing activity, e.g. of a polypeptide having the activity of a protein as indicated in table II, application no. 6, columns 5 and 7 or its homologs activity; and/or e) stimulating activity of a protein conferring the increased expression of a protein encoded by the nucleic acid molecule of the present invention or a polypeptide of the present invention having herein-mentioned linoleic acid increasing activity, e.g. of a polypeptide having the activity of a protein as indicated in table II, application no. 6, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned linoleic acid increasing activity, e.g. of a polypeptide having the activity of a protein as indicated in table II, application no. 6, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned linoleic acid increasing activity, e.g. of a polypeptide having the activity of a protein as indicated in table II, application no. 6, columns 5 and 7 or its homologs activity; and/or h) increasing the expression of the endogenous gene encoding the polypeptide of the invention, e.g. a polypeptide having the activity of a protein as indicated in table II, application no. 6, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned linoleic acid increasing activity, e.g. of polypeptide having the activity of a protein as indicated in table II, application no. 6, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned linoleic acid increasing activity, e.g. of a polypeptide having the activity of a protein as indicated in table II, application no. 6, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned linoleic acid increasing activity, e.g. of a polypeptide having the activity of a protein as indicated in table II, application no. 6, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 6, column 3 or its homologs. Preferably the increase of the fine chemical takes place in plastids.

for the disclosure of the paragraphs [0069.0.0.5] to [0079.0.0.5] see paragraphs [0069.0.0.0] to [0079.0.0.0] above.

The activation of an endogenous polypeptide having above-mentioned activity, e.g. having the activity of a protein as shown in table II, application no. 6, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 6, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 6, column 3. The expression of the chimeric transcription factor in a organism, in particular in a plant, leads to a specific expression of the protein as shown in table II, application no. 6, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.5] to [0084.0.0.5] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous fatty acid composition comprising a higher content of (from a viewpoint of nutritional physiology limited) fatty acids, like palmitate, palmitoleate, stearate and/or oleate.

for the disclosure of this paragraph see paragraph [0086.0.0.0] above.

By influencing the metabolism thus, it is possible to produce, in the process according to the invention, further advantageous compounds. Examples of such compounds are, in addition to linoleic acid, triglycerides, lipids, oils and/or fats containing linoleic acid compounds such as palmitate, palmitoleate, stearate and/or oleate.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 6, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound fatty acids, in particular oleic acid.

for the disclosure of the paragraphs [0090.0.0.5] to [0097.0.0.5] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 6, columns 5 and 7 or a derivative thereof, or
b) a genetic regulatory element, for example a promoter, which is functionally linked to the nucleic acid sequence as shown table I, application no. 6, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 6, columns 5 and 7 joined to a nucleic acid sequence encoding a transit peptide, or a targeting nucleic acid sequence which directs the nucleic acid sequences disclosed in table I, application no. 6, columns 5 and 7 to the organelle preferentially the plastids. Altenatively the inventive nucleic acids sequences consist advantageously of the nucleic acid sequences as depicted in the sequence protocol and disclosed in table I, application no. 6, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose fatty acid content is modified advantageously owing to the nucleic acid molecule of the present invention expressed. This is important for plant breeders since, for example, the nutritional value of plants for poultry is dependent on the abovementioned essential fatty acids and the general amount of fatty acids as energy source in feed. After the activity of the protein as shown in table II, application no. 6, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.5] to [0110.0.0.5] see paragraphs [0102.0.0.0] to [0110.0.0.0] above.

In a preferred embodiment, the fine chemical (linoleic acid) is produced in accordance with the invention and, if desired, is isolated. The production of further fatty acids such as palmitic acid, stearic acid, palmitoleic acid and/or oleic acid mixtures thereof or mixtures of other fatty acids by the process according to the invention is advantageous. It may be advantageous to increase the pool of free fatty acids in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example a fatty acid transporter protein or a compound, which functions as a sink for the desired fatty acid for example for linoleic acid in the organism is useful to increase the production of the respective fine chemical (see Bao and Ohlrogge, Plant Physiol. 1999 August; 120 (4): 1057-1062). Such fatty acid transporter protein may serve as a link between the location of fatty acid synthesis and the socalled sink tissue, in which fatty acids, triglycerides, oils and fats are stored.

In the case of the fermentation of microorganisms, the abovementioned fatty acids may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, spray granulation or by other methods. Preferably the fatty acids or the fatty acid compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fatty acids such as saturated or polyunsaturated fatty acids synthesized in the process according to the invention can advantageously be marketed directly without there being any need for the oils, lipids or fatty acids synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue. However, the fine chemical produced in the process according to the invention can also be isolated from the organisms, advantageously plants, in the form of their oils, fats, lipids and/or free fatty acids. Fatty acids produced by this process can be obtained by harvesting the organisms, either from the crop in which they grow, or from the field. This can be done via pressing or extraction of the plant parts, preferably the plant seeds. To increase the efficiency of oil extraction it is beneficial to clean, to temper and if necessary to hull and to flake the plant material especially the seeds. In this context, the oils, fats, lipids and/or free fatty acids can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as preferably warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid. Thereafter optionally, the free fatty acids are removed by treatment with a base like alkali, for example aqueous KOH or NaOH, or acid hydrolysis, advantageously in the presence of an alcohol such as methanol or ethanol, or via enzymatic cleavage, and isolated via, for example, phase separation and subsequent acidification via, for example, $H_2SO_4$. The fatty acids can also be liberated directly without the above-described processing step. If desired the resulting product can be washed thoroughly with water to remove traces of soap and the alkali remaining in the product and then dried. To remove the pigment remaining in the product, the products can be subjected to bleaching, for example using filler's earth or active charcoal. At the end, the product can be deodorized, for example using steam distillation under vacuum. These chemically pure fatty acids or fatty acid compositions are advantageous for applications in the food industry sector, the cosmetic sector and especially the pharmacological industry sector.

Fatty acids can for example be detected advantageously via GC separation methods. The unambiguous detection for the presence of fatty acid products can be obtained by analyzing recombinant organisms using analytical standard methods: GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). One example is the analysis of fatty acids via FAME and GC-MS or TLC (abbreviations: FAME, fatty acid methyl ester; GC-MS, gas liquid chromatography/mass spectrometry; TLC, thin-layer chromatography. The material to be analyzed can be disrupted by sonication, grinding in a glass mill, liquid nitrogen and grinding or via other applicable methods. After disruption, the material must be centrifuged. The sediment is resuspended in distilled water, heated for 10 minutes at 100° C., cooled on ice and recentrifuged, followed by extraction for one hour at 90° C. in 0.5 M sulfuric acid in methanol with 2% dimethoxypropane, which leads to hydrolyzed oil and lipid compounds, which give transmethylated lipids. These fatty acid methyl esters are extracted in petroleum ether and finally subjected to a GC analysis using a capillary column (Chrompack, WCOT Fused Silica, CP-Wax-52 CB, 25 µm, 0.32 mm) at a temperature gradient of between 170° C. and 240° C. for 20 minutes and 5 minutes at 240° C. The identity of the resulting fatty acid methyl esters must be defined using standards, which are available from commercial sources (i.e. Sigma).

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 6, columns 5 and 7 or a fragment thereof, which confers an increase in the amount of the fine chemical in an organism or a part thereof;
b) nucleic acid molecule comprising, preferably at least the mature form, of the nucleic acid molecule shown in table I, application no. 6, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybidizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 6, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 6, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 6, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 6, columns 5 and 7 by one or more nucleotides. In one embodiment, the nucleic acid molecule used in the process of the invention does not consist of the sequence indicated in table IA, application no. 6, columns 5 and 7. In one embodiment, the nucleic acid molecule used in the process of the invention is less than 100%, 99.999%, 99.99%, 99.9% or 99% identical to a sequence indicated in table IA, application no. 6, columns 5 and 7. In another embodiment, the nucleic acid molecule does not encode a polypeptide of a sequence indicated in table IIA, application no. 6, columns 5 and 7.

In one embodiment, the nucleic acid molecule used in the process of the invention distinguishes over the sequence indicated in table IB, application no. 6, columns 5 and 7, by one or more nucleotides. In one embodiment, the nucleic acid molecule used in the process of the invention does not consist of the sequence indicated in table IB, application no. 6, columns 5 and 7. In one embodiment, the nucleic acid molecule used in the process of the invention is less than 100%, 99.999%, 99.99%, 99.9% or 99% identical to a sequence indicated in table IB, application no. 6, columns 5 and 7. In another embodiment, the nucleic acid molecule does not encode a polypeptide of a sequence indicated in table IIB, application no. 6, columns 5 and 7.

In one embodiment, the nucleic acid molecule used in the process distinguishes over the sequence shown in table I, application no. 6, columns 5 and 7 by one or more nucleotides or does not consist of the sequence shown in table I, application no. 6, columns 5 and 7. In one embodiment, the nucleic acid molecule of the present invention is less than 100%, 99.999%, 99.99%, 99.9% or 99% identical to the sequence shown in table I, application no. 6, columns 5 and 7. In another embodiment, the nucleic acid molecule does not encode a polypeptide of the sequence shown in table II, application no. 6, columns 5 and 7.

for the disclosure of the paragraphs [0118.0.0.5] to [0120.0.0.5] see paragraphs [0118.0.0.0] to [0120.0.0.0] above.

Nucleic acid molecules with the sequence shown in table I, application no. 6, columns 5 and 7, nucleic acid molecules which are derived from the amino acid sequences shown in table II, application no. 6, columns 5 and 7 or from polypeptides comprising the consensus sequence shown in table IV, application no. 6, column 7, or their derivatives or homologues encoding polypeptides with the enzymatic or biological activity of a protein as shown in table II, application no. 6, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 6, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 6, column 3 and conferring the fine chemical increase by expression either in the cytsol or in an organelle such as a plastid or mitochondria or both, preferably in plastids.

for the disclosure of the paragraphs [0126.0.0.5] to [0133.0.0.5] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 6, columns 5 and 7 or the functional homologues thereof as described herein, preferably conferring above-mentioned activity, i.e. conferring the fine chemical increase after increasing its activity, e.g. after increasing the activity of a protein as shown in table II, application no. 6, column 3 by for example expression either in the cytsol or in an organelle such as a plastid or mitochondria or both, preferably in plastids.

for the disclosure of the paragraphs [0135.0.0.5] to [0140.0.0.5] see paragraphs [0135.0.0.0] to [0140.0.0.0] above.

Synthetic oligonucleotide primers for the amplification, e.g. as shown in table II, application no. 6, column 7, by means of polymerase chain reaction can be generated on the basis of a sequence shown herein, for example the sequence shown in table I, application no. 6, columns 5 and 7 or the sequences derived from table II, application no. 6, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 6, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 6, column 3 or further functional homologs of the polypeptide of the invention from other organisms.

for the disclosure of the paragraphs [0144.0.0.5] to [0151.0.0.5] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 6, columns 5 and 7, preferably of table IB, application no. 6, columns 5 and 7 under relaxed hybridization conditions and which code on expression for peptides having the linoleic acid, triglycerides, lipids, oils and/or fats containing linoleic acid increasing activity.

for the disclosure of the paragraphs [0153.0.0.5] to [0159.0.0.5] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 6, columns 5 and 7, preferably shown in table IB, application no. 6, columns 5 and 7 is one which is sufficiently complementary to one of the nucleotide sequences shown in table I, application no. 6, columns 5 and 7, preferably shown in table IB, application no. 6, columns 5 and 7 such that it can hybridize to one of the nucleotide sequences shown in table I, application no. 6, columns 5 and 7, preferably shown in table IB, application no. 6, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 6, columns 5 and 7, preferably shown in table IB, application no. 6, columns 5 and 7, or a portion thereof and preferably has above mentioned activity, in particular having a fine chemical increasing activity after increasing the activity or an activity of a gene product as shown in table II, application no. 6, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 6, columns 5 and 7, preferably shown in table IB, application no. 6, columns 5 and 7, or a portion thereof and encodes a protein having above-mentioned activity, e.g. conferring of a linoleic acid, triglycerides, lipids, oils and/or fats containing linoleic acid increase by for example expression either in the cytsol or in an organelle such as a plastid or mitochondria or both, preferably in plastids, and optionally, the activity of a protein as shown in table II, application no. 6, column 3.

Moreover, the nucleic acid molecule of the invention can comprise only a portion of the coding region of one of the sequences shown in table I, application no. 6, columns 5 and 7, preferably shown in table IB, application no. 6, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 6, columns 5 and 7, an anti-sense sequence of one of the sequences, e.g., set forth in table I, application no. 6, columns 5 and 7, preferably shown in table IB, application no. 6, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 6, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 6, columns 5 and 7 such that the protein or portion thereof maintains the ability to participate in the fine chemical production, in particular a linoleic acid, triglycerides, lipids, oils and/or fats containing linoleic acid increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 6, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 6, columns 5 and 7 and having abovementioned activity, e.g. conferring preferably the increase of the fine chemical by for example expression either in the cytsol or in an organelle such as a plastid or mitochondria or both, preferably in plastids.

for the disclosure of the paragraphs [0168.0.0.5] and [0169.0.0.5] see paragraphs [0168.0.0.0] and [0169.0.0.0] above.

The invention further relates to nucleic acid molecules that differ from one of the nucleotide sequences shown in table I, application no. 6, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 6, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 6, columns 5 and 7 or the functional homologues. In a still further embodiment, the nucleic acid molecule of the invention encodes a full length protein which is substantially homologous to an amino acid sequence shown in table II, application no. 6, columns 5 and 7 or the functional homologues. However, in a preferred embodiment, the nucleic acid molecule of the present invention does not consist of the sequence shown in table I, application no. 6, columns 5 and 7, preferably as indicated in table IA, application no. 6, columns 5 and 7. Preferably the nucleic acid molecule of the invention is a functional homologue or identical to a nucleic acid molecule indicated in table IB, application no. 6, columns 5 and 7.

for the disclosure of the paragraphs [0171.0.0.5] to [0173.0.0.5] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 6, columns 5 and 7. The nucleic acid molecule is preferably at least 20, 30, 50, 100, 250 or more nucleotides in length.

for the disclosure of this paragraph see paragraph [0175.0.0.0] above. [0176.0.5.5] Preferably, nucleic acid molecule of the invention that hybridizes under stringent conditions to a sequence shown in table I, application no. 6, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having abovementioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above. [0178.0.5.5] For example, nucleotide substitutions leading to amino acid substitutions at "nonessential" amino acid residues can be made in a sequence of the nucleic acid molecule of the invention or used in the process of the invention, e.g. shown in table I, application no. 6, columns 5 and 7.

for the disclosure of the paragraphs [0179.0.0.5] and [0180.0.0.5] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 6, columns 5 and 7, preferably shown in table IIA, application no. 6, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 6, columns 5 and 7, preferably shown in table IIA, application no. 6, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 6, columns 5 and 7, preferably shown in table IIA, application no. 6, columns 5 and 7, more preferably at least about 70% identical to one of the sequences shown in table II, application no. 6, columns 5 and 7, preferably shown in table IIA, application no. 6, columns 5 and 7, even more preferably at least about 80%, 90%, 95% homologous to the sequence shown in table II, application no. 6, columns 5 and 7, preferably shown in table IIA, application no. 6, columns 5 and 7, and most preferably at least about 96%, 97%, 98%, or 99% identical to the sequence shown in table II, application no. 6, columns 5 and 7, preferably shown in table IIA, application no. 6, columns 5 and 7.

for the disclosure of the paragraphs [0182.0.0.5] to [0188.0.0.5] see paragraphs [0182.0.0.0] to [0188.0.0.0] above.

Functional equivalents derived from one of the polypeptides as shown in table II, application no. 6, columns 5 and 7, preferably shown in table IIB, application no. 6, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 6, columns 5 and 7, preferably shown in table IIB, application no. 6, columns 5 and 7 resp., according to the invention and are distinguished by essentially the same properties as the polypeptide as shown in table II, application no. 6, columns 5 and 7, preferably shown in table IIB, application no. 6, columns 5 and 7.

Functional equivalents derived from the nucleic acid sequence as shown in table I, application no. 6, columns 5 and 7, preferably shown in table IB, application no. 6, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 6, columns 5 and 7, preferably shown in table IIB, application no. 6, columns 5 and 7 resp., according to the invention and encode polypeptides having essentially the same properties as the polypeptide as shown in table II, application no. 6, columns 5 and 7, preferably shown in table IIB, application no. 6, columns 5 and 7.

for the disclosure of this paragraph see paragraph [0191.0.0.0] above.

A nucleic acid molecule encoding an homologous to a protein sequence of table II, application no. 6, columns 5 and 7, preferably shown in table IIB, application no. 6, columns 5 and 7 resp., can be created by introducing one or more nucleotide substitutions, additions or deletions into a nucleotide sequence of the nucleic acid molecule of the present invention, in particular of table I, application no. 6, columns 5 and 7, preferably shown in table IB, application no. 6, columns 5 and 7 resp., such that one or more amino acid substitutions, additions or deletions are introduced into the encoded protein. Mutations can be introduced into the encoding sequences of table I, application no. 6, columns 5 and 7, preferably shown in table IB, application no. 6, columns 5 and 7 resp., by standard techniques, such as site-directed mutagenesis and PCR-mediated mutagenesis.

for the disclosure of the paragraphs [0193.0.0.5] to [0196.0.0.5] see paragraphs [0193.0.0.0] to [0196.0.0.0] above.

Homologues of the nucleic acid sequences used, with the sequence shown in table I, application no. 6, columns 5 and 7, preferably shown in table IB, application no. 6, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 6, columns 5 and 7, preferably shown in table IB, application no. 6, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 6, columns 5 and 7, preferably shown in table IB, application no. 6, columns 5 and 7. It is preferred that the nucleic acid molecule comprises as little as possible other nucleotides not shown in any one of table I, application no. 6, columns 5 and 7, preferably shown in table IB, application no. 6, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 6, columns 5 and 7, preferably shown in table IB, application no. 6, columns 5 and 7.

Also preferred is that the nucleic acid molecule used in the process of the invention encodes a polypeptide comprising the sequence shown in table II, application no. 6, columns 5 and 7, preferably shown in table IIB, application no. 6, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 6, columns 5 and 7, preferably shown in table IIB, application no. 6, columns 5 and 7.

In one embodiment, the nucleic acid molecule of the invention or used in the process encodes a polypeptide comprising the sequence shown in table II, application no. 6, columns 5 and 7, preferably shown in table IIB, application no. 6, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 6, columns 5 and 7, preferably shown in table IB, application no. 6, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 6, columns 5 and 7 expressed under identical conditions.

Homologues of table I, application no. 6, columns 5 and 7 or of the derived sequences of table II, application no. 6, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.5] to [0215.0.0.5] see paragraphs [0203.0.0.0] to [0215.0.0.0] above.

Accordingly, in one embodiment, the invention relates to a nucleic acid molecule, which comprises a nucleic acid molecule selected from the group consisting of:
a) nucleic acid molecule encoding, preferably at least the mature form, of the polypeptide shown in table II, application no. 6, columns 5 and 7, preferably in table II B, application no. 6, columns 5 and 7; or a fragment thereof conferring an increase in the amount of the fine chemical in an organism or a part thereof
b) nucleic acid molecule comprising, preferably at least the mature form, of the nucleic acid molecule shown in table I, application no. 6, columns 5 and 7, preferably in table IB, application no. 6, columns 5 and 7 or a fragment thereof conferring an increase in the amount of the fine chemical in an organism or a part thereof;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybridizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying a cDNA library or a genomic library using the primers in table III, application no. 6, column 7 and conferring an increase in the amount of the fine chemical in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising the consensus sequence shown in table IV, application no. 6, column 7 and conferring an increase in the amount of the fine chemical in an organism or a part thereof;
k) nucleic acid molecule encoding the amino acid sequence of a polypeptide encoding a domain of the polypeptide shown in table II, application no. 6, columns 5 and 7 and conferring an increase in the amount of the fine chemical in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 6, columns 5 and 7 or a nucleic acid molecule encoding, preferably at least the mature form of, the polypeptide shown in table II, application no. 6, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 6, columns 5 and 7 by one or more nucleotides. In one embodiment, the nucleic acid molecule of the invention does not consist of the sequence shown in table IA and/or IB, application no. 6, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 6, columns 5 and 7. In a further embodiment the nucleic acid molecule does not encode the polypeptide sequence shown in table IIA and/or IIB, application no. 6, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 6, columns 5 and 7 does not encode a protein of the sequence shown in table IIA and/or IIB, application no. 6, columns 5 and 7. Accordingly, in one embodiment, the protein encoded by a sequence of a nucleic acid according to (a) to (l) does not consist of the sequence shown in table IA and/or IB, application no. 6, columns 5 and 7. In a further embodiment, the protein of the present invention is at least 30% identical to protein sequence depicted in table IIA and/or IIB, application no. 6, columns 5 and 7 and less than 100%, preferably less than 99.999%, 99.99% or 99.9%, more preferably less than 99%, 985, 97%, 96% or 95% identical to the sequence shown in table IIA and/or IIB, application no. 6, columns 5 and 7.

for the disclosure of the paragraphs [0217.0.0.5] to [0226.0.0.5] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 6, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.5] to [0239.0.0.5] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 6, columns 5 and 7 or its derivatives, it is advantageous additionally to express and/or mutate further genes in the organisms. Especially advantageously, additionally at least one further gene of the fatty acid biosynthetic pathway such as for palmitate, palmitoleate, stearate and/or oleate is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 6, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the fatty acid metabolism, in particular in fatty acid synthesis.

Further advantageous nucleic acid sequences which can be expressed in combination with the sequences used in the process and/or the abovementioned biosynthesis genes are the sequences encoding further genes of the saturated, poly unsaturated fatty acid biosynthesis such as desaturases like $\Delta$-4-desaturases, $\Delta$-5-desaturases, $\Delta$-6-desaturases, $\Delta$-8-desaturases, $\Delta$-9-desaturases, $\Delta$-12-desaturases, $\Delta$-17-desaturases, $\omega$-3-desaturases, elongases like $\Delta$-5-elongases, $\Delta$-6-elongases, $\Delta$-9-elongases, acyl-CoA-dehydrogenases, acyl-ACP-desaturases, acyl-ACP-thioesterases, fatty acid acyl-transferases, acyl-CoA lysophospholipid-acyltransferases, acyl-CoA carboxylases, fatty acid synthases, fatty acid hydroxylases, acyl-CoA oxydases, acetylenases, lipoxygenases, triacyl-lipases etc. as described in WO 98/46765, WO 98/46763, WO 98/46764, WO 99/64616, WO 00/20603, WO 00/20602, WO 00/40705, US 20040172682, US 20020156254, U.S. Pat. No. 6,677,145 US 20040053379 or US 20030101486. These genes lead to an increased synthesis of the essential fatty acids.

In a further advantageous embodiment of the process of the invention, the organisms used in the process are those in which simultaneously a linoleic acid degrading protein is attenuated, in particular by reducing the rate of expression of the corresponding gene.

The fatty acids produced can be isolated from the organism by methods with which the skilled worker is familiar for example via extraction, salt precipitation and/or different chromatography methods. The process according to the invention can be conducted batchwise, semibatchwise or continuously. The fine chemical produced in the process according to the invention can be isolated as mentioned above from the organisms, advantageously plants, in the form of their oils, fats, lipids and/or free fatty acids. Fatty acids produced by this process can be obtained by harvesting the organisms, either from the crop in which they grow, or from the field. This can be done via pressing or extraction of the plant parts, preferably the plant seeds. Hexane is preferably used as solvent in the process, in which more than 96% of the compounds produced in the process can be isolated. Thereafter, the resulting products are processed further, i.e. degummed, refined, bleached and/or deodorized.

for the disclosure of the paragraphs [0243.0.0.5] to [0264.0.0.5] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 6, columns 5 and 7 and described herein to achieve an expression in one of said compartments or extracellular.

for the disclosure of the paragraphs [0266.0.0.5] to [0287.0.0.5] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 6, columns 5 and 7 or their homologs is functionally linked to a plastidial targeting sequence. A further preferred embodiment of the invention relates to a vector in which a nucleic acid sequence encoding one of the polypeptides shown in table II, application no. 6, columns 5 and 7 or their homologs is functionally linked to a regulatory sequences which permit the expression in plastids.

for the disclosure of the paragraphs [0289.0.0.5] to [0296.0.0.5] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0403, anti-b0931, anti-b1046, anti-b1933, anti-b2126, anti-b3708, anti-b3728 and/or anti-YNR012W protein antibody or an antibody against polypeptides as shown in table II, application no. 6, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 6, columns 5 and 7 or as coded by the nucleic acid molecule shown in table I, application no. 6, columns 5 and 7 or functional homologues thereof.

In one advantageous embodiment, in the method of the present invention the activity of a polypeptide is increased comprising or consisting of the consensus sequence shown in table IV, application no. 6, columns 7 and in one another embodiment, the present invention relates to a polypeptide comprising or consisting of the consensus sequence shown in table IV, application no. 6, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.5] to [0304.0.0.5] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 6, columns 5 and 7 by one or more amino acids. In one embodiment, polypeptide distinguishes form the sequence shown in table IIA and/or IIB, application no. 6, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 6, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 6, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 6, columns 5 and 7 by one or more amino acids. In another embodiment, said polypeptide of the invention does not consist of the sequence shown in table IIA and/or IIB, application no. 6, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 6, columns 5 and 7.

In one embodiment, the present invention relates to a polypeptide having the activity of the protein as shown in table IIA and/or IIB, application no. 6, column 3, which distinguishes over the sequence depicted in table IIA and/or IIB, application no. 6, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.5] to [0311.0.0.5] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 6, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 6, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 6, columns 5 and 7 or which is homologous thereto, as defined above.

Accordingly the polypeptide of the present invention can vary from the sequences shown in table IIA and/or IIB, application no. 6, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 6, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 6, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 6, column 3. Differences shall mean at least one amino acid different from the sequences as shown in table II, application no. 6, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 6, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 6, column 3. The nucleic acid molecules and polypeptide molecules of the invention are expressed such that the yield, production, and/or efficiency of production of a desired compound is improved.

for the disclosure of the paragraphs [0320.0.0.5] to [0322.0.0.5] see paragraphs [0320.0.0.0] to [0322.0.0.0] above.

In one embodiment, a protein (=polypeptide) as shown in table II, application no. 6, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 6, column 3, e.g., a protein which does not confer the activity described herein and which is derived from the same or a different organism.

for the disclosure of the paragraphs [0324.0.0.5] to [0329.0.0.5] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 6, columns 5 and 7.

for the disclosure of the paragraphs [0331.0.0.5] to [0346.0.0.5] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 6, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 6, column 3 or a protein as shown in table II, application no. 6, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 6, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.5] to [0358.0.0.5] see paragraphs [0350.0.0.0] to [0358.0.0.0] above.

Transgenic plants comprising the fatty acids synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The fatty acids produced in the process according to the invention may, however, also be isolated from the plant in the form of their free fatty acids, lipids, oils and/or fats containing said produced fatty acid, that means bound as ester such as triacylglycerides or phospholipids. Fatty acids produced by this process can be isolated by harvesting the plants either from the culture in which they grow or from the field. This can be done for example via expressing, grinding and/or extraction of the plant parts, preferably the plant seeds, plant fruits, plant tubers and the like.

for the disclosure of the paragraphs [0360.0.0.5] to [0362.0.0.5] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the fatty acids produced in the process can be isolated. The resulting fatty acids can, if appropriate, subsequently be further purified, if desired mixed with other active ingredients such as other fatty acids, vitamins, amino acids, carbohydrates, antibiotics and the like, and, if appropriate, formulated.

In one embodiment, the fatty acid is the fine chemical.

The fatty acids obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of a pharmaceuticals, food stuff, animal feeds, nutrients or cosmetics comprising the steps of the process according to the invention, including the isolation of the fatty acid composition produced or the fine chemical produced if desired and formulating the product with a pharmaceutical acceptable carrier or formulating the product in a form acceptable for an application in agriculture. A further embodiment according to the invention is the use of the fatty acids produced in the process or of the transgenic organisms in animal feeds, foodstuffs, medicines, food supplements, cosmetics or pharmaceuticals.

For preparing fatty acid compound-containing fine chemicals, in particular the fine chemical, it is possible to use as fatty acid source organic compounds such as, for example, oils, fats and/or lipids comprising fatty acids such as fatty acids having a carbon back bone between $C_{10}$- to $C_{18}$-carbon atoms and/or small organic acids such acetic acid, propionic acid or butanoic acid as precursor compounds.

for the disclosure of the paragraphs [0366.0.0.5] to [0369.0.0.5] see paragraphs [0366.0.0.0] to [0369.0.0.0] above.

The fermentation broths obtained in this way, containing in particular linoleic acid, triglycerides, lipids, oils and/or fats containing linoleic acid, normally have a dry matter content of from 7.5 to 25% by weight. The fermentation broth can be processed further. Depending on requirements, the biomass can be separated, such as, for example, by centrifugation, filtration, decantation or a combination of these methods, from the fermentation broth or left completely in it. Afterwards the biomass can be extracted without any further process steps or disrupted and then extracted. If necessary the fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction.

However, it is also possible to purify the fatty acid produced further. For this purpose, the product-containing composition is subjected for example to a thin layer chromatography on silica gel plates or to a chromatography such as a Florisil column (Bouhours J. F., J. Chromatrogr. 1979, 169, 462), in which case the desired product or the impurities are retained wholly or partly on the chromatography resin. These chromatography steps can be repeated if necessary, using the same or different chromatography resins. The skilled worker is familiar with the choice of suitable chromatography resins and their most effective use. An alternative method to purify the fatty acids is for example crystallization in the presence of urea. These methods can be combined with each other.

for the disclosure of the paragraphs [0372.0.0.5] to [0376.0.0.5], [0376.1.0.5] and [0377.0.0.5] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 6, columns 5 and 7, preferably in table IB, application no. 6, columns 5 and 7, and, optionally, isolating the full length cDNA clone or complete genomic clone;

(c) introducing the candidate nucleic acid molecules in host cells, preferably in a plant cell or a microorganism, appropriate for producing the fine chemical;

(d) expressing the identified nucleic acid molecules in the host cells;

(e) assaying the fine chemical level in the host cells; and (f) identifying the nucleic acid molecule and its gene product which expression confers an increase in the fine chemical level in the host cell after expression compared to the wild type.

for the disclosure of the paragraphs [0379.0.0.5] to [0383.0.0.5] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 6, column 3, e.g. comparing near identical organisms with low and high activity of the proteins as shown in table II, application no. 6, column 3.

for the disclosure of the paragraphs [0385.0.0.5] to [0404.0.0.5] see paragraphs [0385.0.0.0] to [0404.0.0.0] above.

Accordingly, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other fatty acids such as palmitic acid or oleic acid.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorgansims, the plant, plant tissue, plant cell, or the part thereof of the invention, the vector of the invention, the agonist identified with the method of the invention, the antibody of the present invention, can be used for the reduction of the fine chemical in a organism or part thereof, e.g. in a cell.

for the disclosure of the paragraphs [0406.0.0.5] to [0435.0.0.5] see paragraphs [0406.0.0.0] to [0435.0.0.0] above.

Linoleic acid, triglycerides, lipids, oils and/or fats containing linoleic acid production in *Mortierella*

The fatty acid production can be analysed as mentioned above. The proteins and nucleic acids can be analysed as mentioned below.

for the disclosure of the paragraphs [0437.0.0.5] and [0438.0.0.5] see paragraphs [0437.0.0.0] and [0438.0.0.0] above.

Example 8

Analysis of the Effect of the Nucleic Acid Molecule on the Production of the Fatty Acid The effect of the genetic modification in plants, fungi, algae or ciliates on the production of a desired compound (such as a fatty acid) can be determined by growing the modified microorganisms or the modified plant under suitable conditions (such as those described above) and analyzing the medium and/or the cellular components for the elevated production of desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications).

In addition to the abovementioned processes, plant lipids are extracted from plant material as described by Cahoon et al. (1999) Proc. Natl. Acad. Sci. USA 96 (22): 12935-12940 and Browse et al. (1986) Analytic Biochemistry 152:141-145. The qualitative and quantitative analysis of lipids or fatty acids is described by Christie, William W., Advances in Lipid Methodology, Ayr/Scotland: Oily Press (Oily Press Lipid Library; 2); Christie, William W., Gas Chromatography and Lipids. A Practical Guide—Ayr, Scotland: Oily Press, 1989, Repr. 1992, IX, 307 pp. (Oily Press Lipid Library; 1); "Progress in Lipid Research, Oxford: Pergamon Press, 1 (1952)-16 (1977) under the title: Progress in the Chemistry of Fats and Other Lipids CODEN.

for the disclosure of this paragraph see [0441.0.0.0] above.

Example 9

Purification of the Fatty Acid

One example is the analysis of fatty acids (abbreviations: FAME, fatty acid methyl ester; GC-MS, gas liquid chromatography/mass spectrometry; TAG, triacylglycerol; TLC, thin-layer chromatography).

The unambiguous detection for the presence of fatty acid products can be obtained by analyzing recombinant organisms using analytical standard methods: GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353).

The total fatty acids produced in the organism for example in yeasts used in the inventive process can be analysed for example according to the following procedure:

The material such as yeasts, *E. coli* or plants to be analyzed can be disrupted by sonication, grinding in a glass mill, liquid nitrogen and grinding or via other applicable methods. After disruption, the material must be centrifuged (1000×g, 10 min., 4° C.) and washed once with 100 mM $NaHCO_3$, pH 8.0 to remove residual medium and fatty acids. For preparation of the fatty acid methyl esters (FAMES) the sediment is resuspended in distilled water, heated for 10 minutes at 100° C., cooled on ice and recentrifuged, followed by extraction for one hour at 90° C. in 0.5 M sulfuric acid in methanol with 2% dimethoxypropane, which leads to hydrolyzed oil and lipid compounds, which give transmethylated lipids.

The FAMES are then extracted twice with 2 ml petrolether, washed once with 100 mM $NaHCO_3$, pH 8.0 and once with distilled water and dried with $Na_2SO_4$. The organic solvent can be evaporated under a stream of Argon and the FAMES were dissolved in 50 µl of petrolether. The samples can be separated on a ZEBRON ZB-Wax capillary column (30 m, 0.32 mm, 0.25 µm; Phenomenex) in a Hewlett Packard 6850 gas chromatograph with a flame ionisation detector. The oven temperature is programmed from 70° C. (1 min. hold) to 200° C. at a rate of 20° C./min., then to 250° C. (5 min. hold) at a rate of 5° C./min and finally to 260° C. at a rate of 5° C./min. Nitrogen is used as carrier gas (4.5 ml/min. at 70° C.). The identity of the resulting fatty acid methyl esters can be identified by comparison with retention times of FAME standards, which are available from commercial sources (i.e. Sigma).

Plant material is initially homogenized mechanically by comminuting in a pestle and mortar to make it more amenable to extraction.

This is followed by heating at 100° C. for 10 minutes and, after cooling on ice, by resedimentation. The cell sediment is hydrolyzed for one hour at 90° C. with 1 M methanolic sulfuric acid and 2% dimethoxypropane, and the lipids are transmethylated. The resulting fatty acid methyl esters (FAMEs) are extracted in petroleum ether. The extracted FAMEs are analyzed by gas liquid chromatography using a capillary column (Chrompack, WCOT Fused Silica, CP-Wax-52 CB, 25 m, 0.32 mm) and a temperature gradient of from 170° C. to 240° C. in 20 minutes and 5 minutes at 240° C. The identity of the fatty acid methyl esters is confirmed by comparison with corresponding FAME standards (Sigma). The identity and position of the double bond can be analyzed further by suitable chemical derivatization of the FAME mixtures, for example to give 4,4-dimethoxyoxazoline derivatives (Christie, 1998) by means of GC-MS.

The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2):293-298 and Michaelson et al., 1998, FEBS Letters. 439(3): 215-218.

If required and desired, further chromatography steps with a suitable resin may follow. Advantageously the fatty acids can be further purified with a so-called RTHPLC. As eluent different an acetonitrile/water or chloroform/acetonitrile mixtures are advantageously is used. For example canola oil can be separated said HPLC method using an RP-18-column (ET 250/3 Nucleosil 120-5 $C_{18}$ Macherey und Nagel, Duren, Germany). A chloroform/acetonitrile mixture (v/v 30:70) is used as eluent. The flow rate is beneficial 0.8 ml/min. For the analysis of the fatty acids an ELSD detector (evaporative light-scattering detector) is used. MPLC, dry-flash chromatography or thin layer chromatography are other beneficial chromatography methods for the purification of fatty acids. If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

for the disclosure of the paragraphs [0446.0.0.5] to [0497.0.0.5] see paragraphs [0446.0.0.0] to [0497.0.0.0] above.

The results of the different plant analyses can be seen from the table, which follows:

TABLE VI

| ORF | Metabolite | Method | Min | Max |
|---|---|---|---|---|
| b0403 | Linoleic Acid (C18:2 (c9, c12)) | GC | 1.15 | 1.38 |
| b0931 | Linoleic Acid (C18:2 (c9, c12)) | GC | 1.16 | 1.45 |
| b1046 | Linoleic Acid (C18:2 (c9, c12)) | GC | 1.15 | 1.22 |
| b1933 | Linoleic Acid (C18:2 (c9, c12)) | GC | 1.14 | 1.22 |
| b2126 | Linoleic Acid (C18:2 (c9, c12)) | GC | 1.14 | 1.24 |
| b3708 | Linoleic Acid (C18:2 (c9, c12)) | GC | 1.15 | 1.39 |
| b3728 | Linoleic Acid (C18:2 (c9, c12)) | GC | 1.15 | 1.21 |
| YNR012W | Linoleic Acid (C18:2 (c9, c12)) | GC | 1.15 | 1.21 | for the disclosure of the paragraphs [0499.0.0.5] and [0500.0.0.5] see paragraphs [0499.0.0.0] and [0500.0.0.0] above.

Example 15a

Engineering Tyegrass Plants by Over-Expressing YNR012W from *Saccharomyces cerevisiae* or Homologs of YNR012W from Other Organisms for the disclosure of the paragraphs [0502.0.0.5] to [0508.0.0.5] see paragraphs [0502.0.0.0] to [0508.0.0.0] above.

Example 15b

Engineering Soybean Plants by Over-Expressing YNR012W from *Saccharomyces cerevisiae* or Homologs of YNR012W from Other Organisms for the disclosure of the paragraphs [0510.0.0.5] to [0513.0.0.5] see paragraphs [0510.0.0.0] to [0513.0.0.0] above.

Example 15c

Engineering Corn Plants by Over-Expressing YNR012W from *Saccharomyces cerevisiae* or Homologs of YNR012W from Other Organisms for the disclosure of the paragraphs [0515.0.0.5] to [0540.0.0.5] see paragraphs [0515.0.0.0] to [0540.0.0.0] above.

Example 15d

Engineering Wheat Plants by Over-Expressing YNR012W from *Saccharomyces cerevisiae* or Homologs of YNR012W from Other Organisms for the disclosure of the paragraphs [0542.0.0.5] to [0544.0.0.5] see paragraphs [0542.0.0.0] to [0544.0.0.0] above.

Example 15e

Engineering Rapeseed/Canola Plants by Over-Expressing YNR012W from *Saccharomyces cerevisiae* or Homologs of YNR012W from Other Organisms for the disclosure of the paragraphs [0546.0.0.5] to [0549.0.0.5] see paragraphs [0544.0.0.0] to [0549.0.0.0] above.

Example 15f

Engineering Alfalfa Plants by Over-Expressing YNR012W from *Saccharomyces cerevisiae* or Homologs of YNR012W from Other Organisms for the disclosure of the paragraphs [0551.0.0.5] to [0554.0.0.5] see paragraphs [0551.0.0.0] to [0554.0.0.0] above.

Example 16

Metabolite Profiling Info from *Zea mays*

*Zea mays* plants were engineered as described in Example 15c.

The results of the different *Zea mays* plants analysed can be seen from table VII, which follows:

TABLE VII

| ORF_NAME | Metabolite | Min | Max |
|---|---|---|---|
| YNR012W | Linoleic acid (C18:2cis[9, 12]) | 1.39 | 3.53 |

Table VII shows the increase in linoleic acid (C18:2cis[9, 12]) in genetically modified corn plants expressing the *Saccharomyces cerevisiae* nucleic acid sequence YNR012W.

In one embodiment, in case the activity of the *Saccharomyces cerevisiae* protein YNR012W or its homologs, e.g. a "uridine kinase", is increased in corn plants, preferably, an increase of the fine chemical linoleic acid between 39% and 253% is conferred.

for the disclosure of this paragraph see [0554.2.0.0] above.
for the disclosure of this paragraph see [0555.0.0.0] above.
for the disclosure of this paragraph see [0001.0.0.0].
for the disclosure of the paragraphs [0002.0.5.6] to [0008.0.5.6] see paragraphs [0002.0.5.5] and [0008.0.5.5] above.

As described above, the essential fatty acids are necessary for humans and many mammals, for example for livestock. Essential fatty acids, such as alpha-linolenic acid, are extremely important for healing and maintaining good health. Compounds made from alpha-linolenic acid have been shown to decrease blood clotting and decrease inflammatory processes in the body.

for the disclosure of the paragraphs [0010.0.5.6] to [0012.0.5.6] see paragraphs [0010.0.5.5] and [0012.0.5.5] above.

for the disclosure of this paragraph see [0013.0.0.0] above.

Accordingly, in a first embodiment, the invention relates to a process for the production of a fine chemical, whereby the fine chemical is α-linolenic acid or triglycerides, lipids, oils or fats containing α-linolenic acid. Accordingly, in the present invention, the term "the fine chemical" as used herein relates to "α-linolenic acid or triglycerides, lipids, oils or fats containing α-linolenic acid". Further, the term "the fine chemicals" as used herein also relates to fine chemicals comprising α-linolenic acid or triglycerides, lipids, oils or fats containing α-linolenic acid.

In one embodiment, the term "the fine chemical" or "the respective fine chemical" means α-linolenic acid or triglycerides, lipids, oils or fats containing α-linolenic acid. Throughout the specification the term "the fine chemical" or "the respective fine chemical" means α-linolenic acid or triglycerides, lipids, oils or fats containing α-linolenic acid, α-linolenic acid and its salts, ester, thioester or α-linolenic acid in free form or bound to other compounds such as triglycerides, glycolipids, phospholipids etc. In a preferred embodiment, the term "the fine chemical" means α-linolenic acid, in free form or its salts or bound to triglycerides. Triglycerides, lipids, oils, fats or lipid mixture thereof shall mean any triglyceride, lipid, oil and/or fat containing any bound or free α-linolenic acid for example sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, or as monoacylglyceride, diacylglyceride or triacylglyceride or other fatty acid esters such as acetyl-Coenzym A thioester, which contain further saturated or unsaturated fatty acids in the fatty acid molecule.

In one embodiment, the term "the fine chemical" and the term "the respective fine chemical" mean at least one chemical compound with an activity of the abovementioned fine chemical.

Accordingly, the present invention relates to a process for the production of α-linolenic acid, which comprises (a) increasing or generating the activity of a protein as shown in table II, application no. 7, column 3 encoded by the nucleic acid sequences as shown in table I, application no. 7, column 5, in an organelle of a microorganism or plant, or (b) increasing or generating the activity of a protein as shown in table II, application no. 7, column 3 encoded by the nucleic acid sequences as shown in table I, application no. 7, column 5 in the plastid of a microorganism or plant, or in one or more parts thereof; and (c) growing the organism under conditions which permit the production of the fine chemical, thus, α-linolenic acid or fine chemicals comprising α-linolenic acid, in said organism or in the culture medium surrounding the organism.
/
In another embodiment the present invention is related to a process for the production of α-linolenic acid, which comprises (a) increasing or generating the activity of a protein as shown in table II, application no. 7, column 3 encoded by the nucleic acid sequences as shown in table I, application no. 7, column 5, in an organelle of a non-human organism, or (b) increasing or generating the activity of a protein as shown in table II, application no. 7, column 3 encoded by the nucleic acid sequences as shown in table I, application no. 7, column 5, which are joined to a nucleic acid sequence encoding a transit peptide in a non-human organism, or in one or more parts thereof; or (c) increasing or generating the activity of a protein as shown in table II, application no. 7, column 3 encoded by the nucleic acid sequences as shown in table I, application no. 7, column 5, which are joined to a nucleic acid sequence encoding chloroplast localization sequence, in a non-human organism, or in one or more parts thereof, and (d) growing the organism under conditions which permit the production of α-linolenic acid in said organism.

In another embodiment, the present invention relates to a process for the production of α-linolenic acid, which comprises (a) increasing or generating the activity of a protein as shown in table II, application no. 7, column 3 encoded by the nucleic acid sequences as shown in table I, application no. 7, column 5, in an organelle of a microorganism or plant through the transformation of the organelle, or (b) increasing or generating the activity of a protein as shown in table II, application no. 7, column 3 encoded by the nucleic acid sequences as shown in table I, application no. 7, column 5 in the plastid of a microorganism or plant, or in one or more parts thereof through the transformation of the plastids; and (c) growing the organism under conditions which permit the production of the fine chemical, thus, α-linolenic acid or fine chemicals comprising α-linolenic acid, in said organism or in the culture medium surrounding the organism.

Advantageously the activity of the protein as shown in table II, application no. 7, column 3 encoded by the nucleic acid sequences as shown in table I, application no. 7, column 5 is increased or generated in the abovementioned process in the plastid of a microorganism or plant.

for the disclosure of the paragraphs [0019.0.0.6] to [0024.0.0.6] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 7, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 7, column 3 and its homologs as disclosed in table I, application no. 7, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 7, column 3 and its homologs as disclosed in table I, application no. 7, columns 5 and 7.

for the disclosure of the paragraphs [0027.0.0.6] to [0029.0.0.6] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 7, columns 5 and 7. The person skilled in the art is able to join said sequences in a functional manner. Advantageously the transit peptide part is cleaved off from the protein part shown in table II, application no. 7, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 7, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 7, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 7, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 7, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 7, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.6] and [0030.3.0.6] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 7, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 7, columns 5 and 7 or a sequence encoding a protein, as depicted in table II, application no. 7, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 7, columns 5 and 7 or a sequence encoding a protein, as depicted in table II, application no. 7, columns 5 and 7 in such a manner that the viroid sequence transports a sequence transcribed from a sequence as depicted in table I, application no. 7, columns 5 and 7 or a sequence encoding a protein as depicted in table II, application no. 7, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 7, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 7, columns 5 and 7.

In a preferred embodiment of the invention the nucleic acid sequences as shown in table I, application no. 7, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 7, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.6] and [0032.0.0.6] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 7, column 3. Preferably the modification of the activity of a protein as shown in table II, application no. 7, column 3 or their combination can be achieved by joining the protein to a transit peptide.

Surprisingly it was found, that the transgenic expression of the *Saccharomyces cerevisiae* protein as shown in table II, application no. 7, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b0342 (Accession number PIR:XX-ECTG) from *Escherichia coli* has been published in Blattner et al., Science 277 (5331), 1453-1474 (1997), and its activity is being defined as "thiogalactoside acetyltransferase". Accordingly, in one embodiment, the process of the present invention comprises the use of a "thiogalactoside acetyltransferase" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b0342 protein is increased or generated, e.g. from *Escherichia coli* or a homolog thereof, preferably linked at least to one transit peptide as mentioned for example in table V.

In another embodiment, in the process of the present invention the activity of a b0342 protein is increased or generated in a subcellular compartment of the organism or organism cell such as in an organelle like a plastid or mitochondria.

The sequence of b0403 (Accession number PIR:C64769) from *Escherichia coli* has been published in Blattner et al., Science 277 (5331), 1453-1474 (1997), and its activity is being defined as "maltodextrin glucosidase". Accordingly, in one embodiment, the process of the present invention comprises the use of a "maltodextrin glucosidase" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b0403 protein is increased or generated, e.g. from *Escherichia coli* or a homolog thereof, preferably linked at least to one transit peptide as mentioned for example in table V.

In another embodiment, in the process of the present invention the activity of a b0403 protein is increased or generated in a subcellular compartment of the organism or organism cell such as in an organelle like a plastid or mitochondria.

The sequence of b0931 (Accession number PIR:JQ0756) from *Escherichia coli* has been published in Blattner et al., Science 277 (5331), 1453-1474 (1997), and its activity is being defined as "nicotinate phosphoribosyltransferase". Accordingly, in one embodiment, the process of the present invention comprises the use of a "nicotinate phosphoribosyltransferase" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b0931 protein is increased or generated, e.g. from *Escherichia coli* or a homolog thereof, preferably linked at least to one transit peptide as mentioned for example in table V.

In another embodiment, in the process of the present invention the activity of a b0931 protein is increased or generated in a subcellular compartment of the organism or organism cell such as in an organelle like a plastid or mitochondria.

The sequence of b1281 (Accession number PIR:DCECOP) from *Escherichia coli* has been published in Blattner et al., Science 277 (5331), 1453-1474 (1997), and its activity is being defined as "orotidine-5'-phosphate decarboxylase". Accordingly, in one embodiment, the process of the present invention comprises the use of a "orotidine-5'-phosphate decarboxylase" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b1281 protein is increased or generated, e.g. from *Escherichia coli* or a homolog thereof, preferably linked at least to one transit peptide as mentioned for example in table V.

In another embodiment, in the process of the present invention the activity of a b1281 protein is increased or generated in a subcellular compartment of the organism or organism cell such as in an organelle like a plastid or mitochondria.

The sequence of b1625 (Accession number PIR:C64919) from *Escherichia coli* has been published in Blattner et al., Science 277 (5331), 1453-1474 (1997), and its activity is being defined as "putative hemolysin expression modulating protein HHA domain". Accordingly, in one embodiment, the process of the present invention comprises the use of a "putative hemolysin expression modulating protein HHA domain" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b1625 protein is increased or generated, e.g. from *Escherichia coli* or a homolog thereof, preferably linked at least to one transit peptide as mentioned for example in table V.

In another embodiment, in the process of the present invention the activity of a b1625 protein is increased or generated in a subcellular compartment of the organism or organism cell such as in an organelle like a plastid or mitochondria.

The sequence of b2156 (Accession number NP_416661) from *Escherichia coli* has been published in Blattner et al., Science 277 (5331), 1453-1474 (1997), and its activity is being defined as "lysine-specific permease". Accordingly, in one embodiment, the process of the present invention comprises the use of a "lysine-specific permease" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b2156 protein is increased or generated, e.g. from *Escherichia coli* or a homolog thereof, preferably linked at least to one transit peptide as mentioned for example in table V.

In another embodiment, in the process of the present invention the activity of a b2156 protein is increased or generated in a subcellular compartment of the organism or organism cell such as in an organelle like a plastid or mitochondria.

The sequence of b2827 (Accession number PIR:SYECT) from *Escherichia coli* has been published in Blattner et al., Science 277 (5331), 1453-1474 (1997), and its activity is being defined as "thymidylate synthetase". Accordingly, in one embodiment, the process of the present invention comprises the use of a "thymidylate synthetase" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b2827 protein is increased or generated, e.g. from *Escherichia coli* or a homolog thereof, preferably linked at least to one transit peptide as mentioned for example in table V.

In another embodiment, in the process of the present invention the activity of a b2827 protein is increased or generated in a subcellular compartment of the organism or organism cell such as in an organelle like a plastid or mitochondria.

The sequence of b3429 (Accession number NP_417887) from *Escherichia coli* has been published in Blattner et al., Science 277 (5331), 1453-1474 (1997), and its activity is being defined as "glycogen synthase (starch synthase)". Accordingly, in one embodiment, the process of the present invention comprises the use of a "glycogen synthase (starch synthase)" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a b3429 protein is increased or generated, e.g. from *Escherichia coli* or a homolog thereof, preferably linked at least to one transit peptide as mentioned for example in table V.

In another embodiment, in the process of the present invention the activity of a b3429 protein is increased or generated in a subcellular compartment of the organism or organism cell such as in an organelle like a plastid or mitochondria. The sequence of YNL241C. (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of α-linolenic acid and/or triglycerides, lipids, oils and/or fats containing α-linolenic acid, in particular for increasing the amount of α-linolenic acid in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of an YNL241C protein is increased or generated in a subcellular compartment of the organism or organism cell such as in an organelle like a plastid or mitochondria.

In one embodiment, the homolog of the YNL241C, is a homolog having said activity and being derived from Eukaryot. In one embodiment, the homolog of the b0342, b0403, b0931, b1281, b1625, b2156, b2827 and/or b3429 is a homolog having said activity and being derived from bacteria. In one embodiment, the homolog of the YNL241C is a homolog having said activity and being derived from Fungi. In one embodiment, the homolog of the b0342, b0403, b0931, b1281, b1625, b2156, b2827 and/or b3429 is a homolog having said activity and being derived from Proteobacteria. In one embodiment, the homolog of the YNL241C is a homolog having said activity and being derived from Ascomycota. In one embodiment, the homolog of the b0342, b0403, b0931, b1281, b1625, b2156, b2827 and/or b3429 is a homolog having said activity and being derived from Gammaproteobacteria. In one embodiment, the homolog of the YNL241C is a homolog having said activity and being derived from *Saccharomycotina*. In one embodiment, the homolog of the b0342, b0403, b0931, b1281, b1625, b2156, b2827 and/or b3429 is a homolog having said activity and being derived from Enterobacteriales. In one embodiment, the homolog of the YNL241C is a homolog having said activity and being derived from *Saccharomycetes*. In one embodiment, the homolog of the b0342, b0403, b0931, b1281, b1625, b2156, b2827 and/or b3429 is a homolog having said activity and being derived from Enterobacteriaceae. In one embodiment, the homolog of the YNL241C is a homolog having said activity and being derived from *Saccharomycetales*. In one embodiment, the homolog of the b0342, b0403, b0931, b1281, b1625, b2156, b2827 and/or b3429 is a homolog having said activity and being derived from *Escherichia*, preferably from *Escherichia coli*. In one embodiment, the homolog of the YNL241C is a homolog having said activity and being derived from Saccharomycetaceae. In one embodiment, the homolog of the YNL241C is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 7, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 7, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 7, column 3, or which has at least 10% of the original enzymatic activity, preferably 20%, particularly preferably 30%, most particularly preferably 40% in comparison to a protein as shown in table II, application no. 7, column 3 of *Saccharomyces cerevisiae*.

for the disclosure of the paragraphs [0040.0.0.6] to [0047.0.0.6] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 7, column 3 its biochemical or genetical causes and the increased amount of the fine chemical.

for the disclosure of the paragraphs [0049.0.0.6] to [0051.0.0.6] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 7, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.6] to [0058.0.0.6] see paragraphs [0053.0.0.0] to [0058.0.0.0] above.

In case the activity of the *Escherichia coli* protein b0342 or its homologs, e.g. a "thiogalactoside acetyltransferase" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 12% and 59% or more is conferred.

In case the activity of the *Escherichia coli* protein b0403 or its homologs, e.g. a "maltodextrin glucosidase" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 12% and 41% or more is conferred.

In case the activity of the *Escherichia coli* protein b0931 or its homologs, e.g. a "nicotinate phosphoribosyltransferase" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 11% and 40% or more is conferred.

In case the activity of the *Escherichia coli* protein b1281 or its homologs, e.g. a "orotidine-5'-phosphate decarboxylase" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 12% and 23% or more is conferred.

In case the activity of the *Escherichia coli* protein b1625 or its homologs, e.g. a "putative hemolysin expression modulating protein HHA domain" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 13% and 23% or more is conferred.

In case the activity of the *Escherichia coli* protein b2156 or its homologs, e.g. a "lysine-specific permease" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 17% and 56% or more is conferred.

In case the activity of the *Escherichia coli* protein b2827 or its homologs, e.g. a "thymidylate synthetase" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 14% and 19% or more is conferred.

In case the activity of the *Escherichia coli* protein b3429 or its homologs, e.g. a "glycogen synthase (starch synthase)" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 12% and 27% or more is conferred.

In case the activity of the *Saccharomyces cerevisiae* protein YNL241C or its homologs, e.g. a "glucose-6-phosphate dehydrogenase" is increased advantageously in an organelle such as a plastid or mitochondria, preferably, in one embodiment an increase of the fine chemical, preferably of α-linolenic acid and/or triglycerides, lipids, oils and/or fats containing α-linolenic acid between 12% and 13% or more is conferred.

In case the activity of the *Escherichia coli* proteins b0342, b0403, b0931, b1281, b1625, b2156, b2827 or b3429 or their homologs," are increased advantageously in an organelle such as a plastid or mitochondria, preferably an increase of the fine chemical α-linolenic acid and/or triglycerides, lipids, oils and/or fats containing α-linolenic acid is conferred.

In case the activity of the *Saccharomyces cerevisiae* protein YNL241C or its homologs, e.g. a "glucose-6-phosphate dehydrogenase" is increased advantageously in an organelle such as a plastid or mitochondria, preferably an increase of the fine chemical α-linolenic acid and/or triglycerides, lipids, oils and/or fats containing α-linolenic acid is conferred.

for the disclosure of the paragraphs [0061.0.0.6] and [0062.0.0.6] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 7, column 7 or of the polypeptide as shown in the amino acid sequences as disclosed in table II, application no. 7, columns 5 and 7 or the functional homologues thereof as described herein, or is encoded by the nucleic acid molecule characterized herein or the nucleic acid molecule according to the invention, for example by the nucleic acid molecule as shown in table I, application no. 7, columns 5 and 7 or its herein described functional homologues and has the herein mentioned activity.

For the purposes of the present invention, the term "α-linolenic acid" also encompasses the corresponding salts, such as, for example, the potassium or sodium salts of α-linolenic acid or the salts of α-linolenic acid with amines such as diethylamine as well as triglycerides, lipids, oils and/or fats containing α-linolenic acid.

for the disclosure of the paragraphs [0065.0.0.6] and [0066.0.0.6] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 7, columns 5 and 7 or its homologs activity having herein-mentioned α-linolenic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 7, columns 5 and 7, e.g. a nucleic acid sequence encoding a polypeptide having the activity of a protein as indicated in table II, application no. 7, columns 5 and 7 or its homologs activity or of a mRNA encoding the polypeptide of the present invention having herein-mentioned α-linolenic acid increasing activity; and/or c) increasing the specific activity of a protein conferring the increased expression of a protein encoded by the nucleic acid molecule of the invention or of the polypeptide of the present invention having herein-mentioned α-linolenic acid increasing activity, e.g. of a polypeptide having the activity of a protein as indicated in table II, application no. 7, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned α-linolenic acid increasing activity, e.g. of a polypeptide having the activity of a protein as indicated in table II, application no. 7, columns 5 and 7 or its homologs activity; and/or
e) stimulating activity of a protein conferring the increased expression of a protein encoded by the nucleic acid molecule of the present invention or a polypeptide of the present invention having herein-mentioned α-linolenic acid increasing activity, e.g. of a polypeptide having the activity of a protein as indicated in table II, application no. 7, columns 5 and 7 or its homologs activity, by adding one or more exogenous inducing factors to the organisms or parts thereof; and/or
f) expressing a transgenic gene encoding a protein conferring the increased expression of a polypeptide encoded by the nucleic acid molecule of the present invention or a polypeptide of the present invention, having herein-mentioned α-linolenic acid increasing activity, e.g. of a polypeptide having the activity of a protein as indicated in table II, application no. 7, columns 5 and 7 or its homologs activity, and/or
g) increasing the copy number of a gene conferring the increased expression of a nucleic acid molecule encoding a polypeptide encoded by the nucleic acid molecule of the invention or the polypeptide of the invention having herein-mentioned α-linolenic acid increasing activity, e.g. of a polypeptide having the activity of a protein as indicated in table II, application no. 7, columns 5 and 7 or its homologs activity; and/or
h) increasing the expression of the endogenous gene encoding the polypeptide of the invention, e.g. a polypeptide having the activity of a protein as indicated in table II, application no. 7, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or
i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or
j) selecting of organisms with especially high activity of the proteins of the invention from natural or from mutagenized resources and breeding them into the target organisms, e.g. the elite crops; and/or
k) directing a protein encoded by the nucleic acid molecule of the invention or of the polypeptide of the present invention having herein-mentioned α-linolenic acid increasing activity, e.g. of polypeptide having the activity of a protein as indicated in table II, application no. 7, columns 5 and 7 or its homologs activity, to the plastids by the addition of a plastidial targeting sequence; and/or
l) generating the expression of a protein encoded by the nucleic acid molecule of the invention or of the polypeptide of the present invention having herein-mentioned α-linolenic acid increasing activity, e.g. of a polypeptide having the activity of a protein as indicated in table II, application no. 7, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or
m) generating the expression of a protein encoded by the nucleic acid molecule of the invention or of the polypeptide of the present invention having herein-mentioned α-linolenic acid increasing activity, e.g. of a polypeptide having the activity of a protein as indicated in table II, application no. 7, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 7, column 3 or its homologs. Preferably the increase of the fine chemical takes place in plastids.

for the disclosure of the paragraphs [0069.0.0.6] to [0079.0.0.6] see paragraphs [0069.0.0.0] to [0079.0.0.0] above.

The activation of an endogenous polypeptide having above-mentioned activity, e.g. having the activity of a protein as shown in table II, application no. 7, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 7, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 7, column 3. The expression of the chimeric transcription factor in a organism, in particular in a plant, leads to a specific expression of the protein as shown in table II, application no. 7, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.6] to [0084.0.0.6] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous fatty acid composition comprising a higher content of (from a viewpoint of nutrional physiology limited) fatty acids, like palmitate, palmitoleate, stearate and/or oleate.

for the disclosure of this paragraph see paragraph [0086.0.0.0] above.

By influencing the metabolism thus, it is possible to produce, in the process according to the invention, further advantageous compounds. Examples of such compounds are, in addition to α-linolenic acid, triglycerides, lipids, oils and/or fats containing α-linolenic acid compounds such as palmitate, palmitoleate, stearate, oleate and/or linoleate.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 7, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound fatty acids, in particular oleic acid and/or linoleic acid.

for the disclosure of the paragraphs [0090.0.0.6] to [0097.0.0.6] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 7, columns 5 and 7 or a derivative thereof, or
b) a genetic regulatory element, for example a promoter, which is functionally linked to the nucleic acid sequence as shown table I, application no. 7, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 7, columns 5 and 7 joined to a nucleic acid sequence encoding a transit peptide, or a targeting nucleic acid sequence which directs the nucleic acid sequences disclosed in table I, application no. 7, columns 5 and 7 to the organelle preferentially the plastids. Altenatively the inventive nucleic acids sequences consist advantageously of the nucleic acid sequences as depicted in the sequence protocol and disclosed in table I, application no. 7, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose fatty acid content is modified advantageously owing to the nucleic acid molecule of the present invention expressed. This is important for plant breeders since, for example, the nutritional value of plants for poultry is dependent on the abovementioned essential fatty acids and the general amount of fatty acids as energy source in feed. After the activity of the protein as shown in table II, application no. 7, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.6] to [0110.0.0.6] see paragraphs [0102.0.0.0] to [0110.0.0.0] above.

In a preferred embodiment, the fine chemical (α-linolenic acid) is produced in accordance with the invention and, if desired, is isolated. The production of further fatty acids such as palmitic acid, stearic acid, palmitoleic acid, oleic acid and/or linoleic acid mixtures thereof or mixtures of other fatty acids by the process according to the invention is advantageous. It may be advantageous to increase the pool of free fatty acids in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example a fatty acid transporter protein or a compound, which functions as a sink for the desired fatty acid for example for α-linolenic acid in the organism is useful to increase the production of the respective fine chemical (see Bao and Ohlrogge, Plant Physiol. 1999 August; 120 (4):

1057-1062). Such fatty acid transporter protein may serve as a link between the location of fatty acid synthesis and the socalled sink tissue, in which fatty acids, triglycerides, oils and fats are stored.

for the disclosure of the paragraphs [0113.0.5.6] to [0115.0.5.6] see paragraphs [0113.0.5.5] to [0115.0.5.5] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:
a) nucleic acid molecule encoding, preferably at least the mature form, of the polypeptide shown in table II, application no. 7, columns 5 and 7 or a fragment thereof, which confers an increase in the amount of the fine chemical in an organism or a part thereof;
b) nucleic acid molecule comprising, preferably at least the mature form, of the nucleic acid molecule shown in table I, application no. 7, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybidizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 7, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 7, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 7, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 7, columns 5 and 7 by one or more nucleotides. In one embodiment, the nucleic acid molecule used in the process of the invention does not consist of the sequence indicated in table IA, application no. 7, columns 5 and 7. In one embodiment, the nucleic acid molecule used in the process of the invention is less than 100%, 99.999%, 99.99%, 99.9% or 99% identical to a sequence indicated in table IA, application no. 7, columns 5 and 7. In another embodiment, the nucleic acid molecule does not encode a polypeptide of a sequence indicated in table IIA, application no. 7, columns 5 and 7.

In one embodiment, the nucleic acid molecule used in the process of the invention distinguishes over the sequence indicated in table IB, application no. 7, columns 5 and 7, by one or more nucleotides. In one embodiment, the nucleic acid molecule used in the process of the invention does not consist of the sequence indicated in table IB, application no. 7, columns 5 and 7. In one embodiment, the nucleic acid molecule used in the process of the invention is less than 100%, 99.999%, 99.99%, 99.9% or 99% identical to a sequence indicated in table IB, application no. 7, columns 5 and 7. In another embodiment, the nucleic acid molecule does not encode a polypeptide of a sequence indicated in table IIB, application no. 7, columns 5 and 7.

In one embodiment, the nucleic acid molecule used in the process distinguishes over the sequence shown in table I, application no. 7, columns 5 and 7 by one or more nucleotides or does not consist of the sequence shown in table I, application no. 7, columns 5 and 7. In one embodiment, the nucleic acid molecule of the present invention is less than 100%, 99.999%, 99.99%, 99.9% or 99% identical to the sequence shown in table I, application no. 7, columns 5 and 7. In another embodiment, the nucleic acid molecule does not encode a polypeptide of the sequence shown in table II, application no. 7, columns 5 and 7.

for the disclosure of the paragraphs [0118.0.0.6] to [0120.0.0.6] see paragraphs [0118.0.0.0] to [0120.0.0.0] above.

Nucleic acid molecules with the sequence shown in table I, application no. 7, columns 5 and 7, nucleic acid molecules which are derived from the amino acid sequences shown in table II, application no. 7, columns 5 and 7 or from polypeptides comprising the consensus sequence shown in table IV, application no. 7, column 7, or their derivatives or homologues encoding polypeptides with the enzymatic or biological activity of a protein as shown in table II, application no. 7, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 7, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 7, column 3 and conferring the fine chemical increase by expression either in the cytsol or in an organelle such as a plastid or mitochondria or both, preferably in plastids.

for the disclosure of the paragraphs [0126.0.0.6] to [33.0.0.6] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 7, columns 5 and 7 or the functional homologues thereof as described herein, preferably conferring above-mentioned activity, i.e. conferring the fine chemical increase after increasing its activity, e.g. after increasing the activity of a protein as shown in table II, application no. 7, column 3 by for example expression either in the cytsol or in an organelle such as a plastid or mitochondria or both, preferably in plastids.

for the disclosure of the paragraphs [0135.0.0.6] to [40.0.0.6] see paragraphs [0135.0.0.0] to [0140.0.0.0] above.

Synthetic oligonucleotide primers for the amplification, e.g. as shown in table III, application no. 7, column 7, by means of polymerase chain reaction can be generated on the basis of a sequence shown herein, for example the sequence shown in table I, application no. 7, columns 5 and 7 or the sequences derived from table II, application no. 7, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 7, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 7, column 3 or further functional homologs of the polypeptide of the invention from other organisms.

for the disclosure of the paragraphs [0144.0.0.6] to [51.0.0.6] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 7, columns 5 and 7, preferably of table IB, application no. 7, columns 5 and 7 under relaxed hybridization conditions and which code on expression for peptides having the α-linolenic acid, triglycerides, lipids, oils and/or fats containing α-linolenic acid increasing activity.

for the disclosure of the paragraphs [0153.0.0.6] to [59.0.0.6] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 7, columns 5 and 7, preferably shown in table IB, application no. 7, columns 5 and 7 is one which is sufficiently complementary to one of the nucleotide sequences shown in table I, application no. 7, columns 5 and 7, preferably shown in table IB, application no. 7, columns 5 and 7 such that it can hybridize to one of the nucleotide sequences shown in table I, application no. 7, columns 5 and 7, preferably shown in table IB, application no. 7, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 7, columns 5 and 7, preferably shown in table IB, application no. 7, columns 5 and 7, or a portion thereof and preferably has above mentioned activity, in particular having a fine chemical increasing activity after increasing the activity or an activity of a gene product as shown in table II, application no. 7, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 7, columns 5 and 7, preferably shown in table IB, application no. 7, columns 5 and 7, or a portion thereof and encodes a protein having above-mentioned activity, e.g. conferring of a α-linolenic acid, triglycerides, lipids, oils and/or fats containing α-linolenic acid increase by for example expression either in the cytsol or in an organelle such as a plastid or mitochondria or both, preferably in plastids, and optionally, the activity of a protein as shown in table II, application no. 7, column 3.

Moreover, the nucleic acid molecule of the invention can comprise only a portion of the coding region of one of the sequences shown in table I, application no. 7, columns 5 and 7, preferably shown in table IB, application no. 7, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 7, columns 5 and 7, an anti-sense sequence of one of the sequences, e.g., set forth in table I, application no. 7, columns 5 and 7, preferably shown in table IB, application no. 7, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table II, application no. 7, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 7, columns 5 and 7 such that the protein or portion thereof maintains the ability to participate in the fine chemical production, in particular a α-linolenic acid, triglycerides, lipids, oils and/or fats containing α-linolenic acid increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 7, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 7, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.6] and [69.0.0.6] see paragraphs [0168.0.0.0] and [0169.0.0.0] above.

The invention further relates to nucleic acid molecules that differ from one of the nucleotide sequences shown in table I, application no. 7, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 7, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 7, columns 5 and 7 or the functional homologues. In a still further embodiment, the nucleic acid molecule of the invention encodes a full length protein which is substantially homologous to an amino acid sequence shown in table II, application no. 7, columns 5 and 7 or the functional homologues. However, in a preferred embodiment, the nucleic acid molecule of the present invention does not consist of the sequence shown in table I, application no. 7, columns 5 and 7, preferably as indicated in table IA, application no. 7, columns 5 and 7. Preferably the nucleic acid molecule of the invention is a functional homologue or identical to a nucleic acid molecule indicated in table IB, application no. 7, columns 5 and 7.

for the disclosure of the paragraphs [0171.0.0.6] to [73.0.0.6] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 7, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 7, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 7, columns 5 and 7.

for the disclosure of the paragraphs [0179.0.0.6] and [80.0.0.6] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 7, columns 5 and 7, preferably shown in table IIA, application no. 7, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 7, columns 5 and 7, preferably shown in table IIA, application no. 7, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 7, columns 5 and 7, preferably shown in table IIA, application no. 7, columns 5 and 7, more preferably at least about 70% identical to one of the sequences shown in table II, application no. 7, columns 5 and 7, preferably shown in table IIA, application no. 7, columns 5 and 7, even more preferably at least about 80%, 90%, 95% homologous to the sequence shown in table II, application no. 7, columns 5 and 7, preferably shown in table IIA, application no. 7, columns 5 and 7, and most preferably at least about 96%, 97%, 98%, or 99% identical to the sequence shown in table II, application no. 7, columns 5 and 7, preferably shown in table IIA, application no. 7, columns 5 and 7.

for the disclosure of the paragraphs [0182.0.0.6] to [88.0.0.6] see paragraphs [0182.0.0.0] to [0188.0.0.0] above.

Functional equivalents derived from one of the polypeptides as shown in table II, application no. 7, columns 5 and 7, preferably shown in table IIB, application no. 7, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 7, columns 5 and 7, preferably shown in table IIB, application no. 7, columns 5 and 7 resp., according to the invention and are distinguished by essentially the same properties as the polypeptide as shown in table II, application no. 7, columns 5 and 7, preferably shown in table IIB, application no. 7, columns 5 and 7.

Functional equivalents derived from the nucleic acid sequence as shown in table I, application no. 7, columns 5 and 7, preferably shown in table IB, application no. 7, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 7, columns 5 and 7, preferably shown in table IIB, application no. 7, columns 5 and 7 resp., according to the invention and encode polypeptides having essentially the same properties as the polypeptide as shown in table II, application no. 7, columns 5 and 7, preferably shown in table IIB, application no. 7, columns 5 and 7.

for the disclosure of this paragraph see paragraph [0191.0.0.0] above.

A nucleic acid molecule encoding an homologous to a protein sequence of table II, application no. 7, columns 5 and 7, preferably shown in table IIB, application no. 7, columns 5 and 7 resp., can be created by introducing one or more nucleotide substitutions, additions or deletions into a nucleotide sequence of the nucleic acid molecule of the present invention, in particular of table I, application no. 7, columns 5 and 7, preferably shown in table IB, application no. 7, columns 5 and 7 resp., such that one or more amino acid substitutions, additions or deletions are introduced into the encoded protein. Mutations can be introduced into the encoding sequences of table I, application no. 7, columns 5 and 7, preferably shown in table IB, application no. 7, columns 5 and 7 resp., by standard techniques, such as site-directed mutagenesis and PCR-mediated mutagenesis.

for the disclosure of the paragraphs [0193.0.0.6] to [96.0.0.6] see paragraphs [0193.0.0.0] to [0196.0.0.0] above.

Homologues of the nucleic acid sequences used, with the sequence shown in table I, application no. 7, columns 5 and 7, preferably shown in table IB, application no. 7, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 7, columns 5 and 7, preferably shown in table IB, application no. 7, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 7, columns 5 and 7, preferably shown in table IB, application no. 7, columns 5 and 7. It is preferred that the nucleic acid molecule comprises as little as possible other nucleotides not shown in any one of table I, application no. 7, columns 5 and 7, preferably shown in table IB, application no. 7, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 7, columns 5 and 7, preferably shown in table IB, application no. 7, columns 5 and 7.

Also preferred is that the nucleic acid molecule used in the process of the invention encodes a polypeptide comprising the sequence shown in table II, application no. 7, columns 5 and 7, preferably shown in table IIB, application no. 7, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 7, columns 5 and 7, preferably shown in table IIB, application no. 7, columns 5 and 7.

In one embodiment, the nucleic acid molecule of the invention or used in the process encodes a polypeptide comprising the sequence shown in table II, application no. 7, columns 5 and 7, preferably shown in table IIB, application no. 7, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 7, columns 5 and 7, preferably shown in table IB, application no. 7, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 7, columns 5 and 7 expressed under identical conditions.

Homologues of table I, application no. 7, columns 5 and 7 or of the derived sequences of table II, application no. 7, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.6] to [215.0.0.6] see paragraphs [0203.0.0.0] to [0215.0.0.0] above.

Accordingly, in one embodiment, the invention relates to a nucleic acid molecule, which comprises a nucleic acid molecule selected from the group consisting of:
a) nucleic acid molecule encoding, preferably at least the mature form, of the polypeptide shown in table II, application no. 7, columns 5 and 7, preferably in table II B, application no. 7, columns 5 and 7; or a fragment thereof conferring an increase in the amount of the fine chemical in an organism or a part thereof
b) nucleic acid molecule comprising, preferably at least the mature form, of the nucleic acid molecule shown in table I, application no. 7, columns 5 and 7, preferably in table IB, application no. 7, columns 5 and 7 or a fragment thereof conferring an increase in the amount of the fine chemical in an organism or a part thereof;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybridizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying a cDNA library or a genomic library using the primers in table III, application no. 7, column 7 and conferring an increase in the amount of the fine chemical in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising the consensus sequence shown in table IV, application no. 7, column 7 and conferring an increase in the amount of the fine chemical in an organism or a part thereof;
k) nucleic acid molecule encoding the amino acid sequence of a polypeptide encoding a domain of the polypeptide shown in table II, application no. 7, columns 5 and 7 and conferring an increase in the amount of the fine chemical in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 7, columns 5 and 7 or a nucleic acid molecule encoding, preferably at least the mature form of, the polypeptide shown in table II, application no. 7, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 7, columns 5 and 7 by one or more nucleotides. In one embodiment, the nucleic acid molecule of the invention does not consist of the sequence shown in table IA and/or IB, application no. 7, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 7, columns 5 and 7. In a further embodiment the nucleic acid molecule does not encode the polypeptide sequence shown in table IIA and/or IIB, application no. 7, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 7, columns 5 and 7 does not encode a protein of the sequence shown in table IIA and/or IIB, application no. 7, columns 5 and 7. Accordingly, in one embodiment, the protein encoded by a sequence of a nucleic acid according to (a) to (l) does not consist of the sequence shown in table IA and/or IB, application no. 7, columns 5 and 7. In a further embodiment, the protein of the present invention is at least 30% identical to protein sequence depicted in table IIA and/or IIB, application no. 7, columns 5 and 7 and less than 100%, preferably less than 99.999%, 99.99% or 99.9%, more preferably less than 99%, 985, 97%, 96% or 95% identical to the sequence shown in table IIA and/or IIB, application no. 7, columns 5 and 7.

for the disclosure of the paragraphs [0217.0.0.6] to [226.0.0.6] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 7, columns 5 and 7 can be cloned 3'prime to the transitpeptide encoding sequence, leading to a functional pre-protein, which is directed to the plastids and which means that the mature protein fulfills its biological activity.

for the disclosure of the paragraphs [0228.0.0.6] to [239.0.0.6] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 7, columns 5 and 7 or its derivatives, it is advantageous additionally to express and/or mutate further genes in the organisms. Especially advantageously, additionally at least one further gene of the fatty acid biosynthetic pathway such as for palmitate, palmitoleate, stearate and/or oleate is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 7, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.5.6] and [242.0.5.6] see paragraphs [0241.0.5.5] and [0242.0.5.5] above.

In a further advantageous embodiment of the process of the invention, the organisms used in the process are those in which simultaneously a α-linolenic acid degrading protein is attenuated, in particular by reducing the rate of expression of the corresponding gene.

for the disclosure of this paragraph see paragraph [0242.2.5.5] above.

for the disclosure of the paragraphs [0243.0.0.6] to [264.0.0.6] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 7, columns 5 and 7 and described herein to achieve an expression in one of said compartments or extracellular.

for the disclosure of the paragraphs [0266.0.0.6] to [287.0.0.6] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 7, columns 5 and 7 or their homologs is functionally linked to a plastidial targeting sequence. A further preferred embodiment of the invention relates to a vector in which a nucleic acid sequence encoding one of the polypeptides shown in table II, application no. 7, columns 5 and 7 or their homologs is functionally linked to a regulatory sequences which permit the expression in plastids.

for the disclosure of the paragraphs [0289.0.0.6] to [296.0.0.6] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0342, anti-b0403, anti-b0931, anti-b1281, anti-b1625, anti-b2156, anti-b2827, anti-b3429 and/or anti-YNL241C protein antibody or an antibody against polypeptides as shown in table II, application no. 7, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 7, columns 5 and 7 or as coded by the nucleic acid molecule shown in table I, application no. 7, columns 5 and 7 or functional homologues thereof.

In one advantageous embodiment, in the method of the present invention the activity of a polypeptide is increased comprising or consisting of the consensus sequence shown in table IV, application no. 7, columns 7 and in one another embodiment, the present invention relates to a polypeptide comprising or consisting of the consensus sequence shown in table IV, application no. 7, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.6] to [304.0.0.6] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 7, columns 5 and 7 by one or more amino acids. In one embodiment, polypeptide distinguishes form the sequence shown in table IIA and/or IIB, application no. 7, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 7, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 7, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 7, columns 5 and 7 by one or more amino acids. In another embodiment, said polypeptide of the invention does not consist of the sequence shown in table IIA and/or IIB, application no. 7, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 7, columns 5 and 7.

In one embodiment, the present invention relates to a polypeptide having the activity of the protein as shown in table IIA and/or IIB, application no. 7, column 3, which distinguishes over the sequence depicted in table IIA and/or IIB, application no. 7, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.6] to [311.0.0.6] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table 11, application no. 7, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 7, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 7, columns 5 and 7 or which is homologous thereto, as defined above.

Accordingly the polypeptide of the present invention can vary from the sequences shown in table IIA and/or IIB, application no. 7, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 7, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 7, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 7, column 3. Differences shall mean at least one amino acid different from the sequences as shown in table II, application no. 7, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 7, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 7, column 3. The nucleic acid molecules and polypeptide molecules of the invention are expressed such that the yield, production, and/or efficiency of production of a desired compound is improved.

for the disclosure of the paragraphs [0320.0.0.6] to [322.0.0.6] see paragraphs [0320.0.0.0] to [0322.0.0.0] above.

In one embodiment, a protein (=polypeptide) as shown in table II, application no. 7, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 7, column 3, e.g., a protein which does not confer the activity described herein and which is derived from the same or a different organism.

for the disclosure of the paragraphs [0324.0.0.6] to [329.0.0.6] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 7, columns 5 and 7.

for the disclosure of the paragraphs [0331.0.0.6] to [346.0.0.6] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 7, column 3. Due to the above mentioned activity the fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 7, column 3 or a protein as shown in table II, application no. 7, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 7, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.6] to [358.0.0.6] see paragraphs [0350.0.0.0] to [0358.0.0.0] above.

for the disclosure of the paragraphs [0350.0.0.6] to [0358.0.0.6] and [0359.0.5.6] see paragraphs [0350.0.0.0] to [358.0.0.0] and [0359.0.5.5] above.

for the disclosure of the paragraphs [0360.0.0.6] to [362.0.0.6] see paragraphs [0360.0.0.0] to [0362.0.0.0] above.

for the disclosure of the paragraphs [0363.0.5.6] to [365.0.5.6] see paragraphs [0363.0.5.5] to [0365.0.5.5] above.

for the disclosure of the paragraphs [0366.0.0.6] to [369.0.0.6] see paragraphs [0366.0.0.0] to [0369.0.0.0] above.

The fermentation broths obtained in this way, containing in particular α-linolenic acid, triglycerides, lipids, oils and/or fats containing α-linolenic acid, normally have a dry matter content of from 7.5 to 25% by weight. The fermentation broth can be processed further. Depending on requirements, the biomass can be separated, such as, for example, by centrifugation, filtration, decantation or a combination of these methods, from the fermentation broth or left completely in it. Afterwards the biomass can be extracted without any further process steps or disrupted and then extracted. If necessary the fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction.

for the disclosure of this paragraph see paragraph [0371.0.5.5] above.

for the disclosure of the paragraphs [0372.0.0.6] to [0376.0.0.6], [0376.1.0.6] and [0377.0.0.6] see paragraphs [372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 7, columns 5 and 7, preferably in table IB, application no. 7, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.6] to [383.0.0.6] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 7, column 3, e.g. comparing near identical organisms with low and high activity of the proteins as shown in table II, application no. 7, column 3.

for the disclosure of the paragraphs [0385.0.0.6] to [404.0.0.6] see paragraphs [0385.0.0.0] to [0404.0.0.0] above.

for the disclosure of this paragraph see paragraph [0405.0.5.5] above.

for the disclosure of the paragraphs [0406.0.0.6] to [435.0.0.6] see paragraphs [0406.0.0.0] to [0435.0.0.0] above.

α-linolenic acid, triglycerides, lipids, oils and/or fats containing α-linolenic acid production in *Mortierella*

The fatty acid production can be analysed as mentioned above. The proteins and nucleic acids can be analysed as mentioned below.

for the disclosure of the paragraphs [0437.0.0.6] and [438.0.0.6] see paragraphs [0437.0.0.0] and [0438.0.0.0] above.

for the disclosure of the paragraphs [0439.0.5.6] and [440.0.5.6] see paragraphs [0439.0.5.5] and [0440.0.5.5] above.

for the disclosure of this paragraph see [0441.0.0.0] above.

for the disclosure of the paragraphs [0442.0.5.6] and [445.0.5.6] see paragraphs [0442.0.5.5] and [0445.0.5.5] above.

for the disclosure of the paragraphs [0446.0.0.6] to [497.0.0.6] see paragraphs [0446.0.0.0] to [0497.0.0.0] above.

The results of the different plant analyses can be seen from the table, which follows:

TABLE VI

| ORF | Metabolite | Method | Min | Max |
|---|---|---|---|---|
| b0342 | α-Linolenic Acid, C18:3 (c9, c12, c15) | GC | 1.12 | 1.59 |
| b0403 | α-Linolenic Acid, C18:3 (c9, c12, c15) | GC | 1.12 | 1.41 |
| b0931 | α-Linolenic Acid, C18:3 (c9, c12, c15) | GC | 1.11 | 1.40 |
| b1281 | α-Linolenic Acid, C18:3 (c9, c12, c15) | GC | 1.12 | 1.23 |
| b1625 | α-Linolenic Acid, C18:3 (c9, c12, c15) | GC | 1.13 | 1.23 |
| b2156 | α-Linolenic Acid, C18:3 (c9, c12, c15) | GC | 1.17 | 1.56 |
| b2827 | α-Linolenic Acid, C18:3 (c9, c12, c15) | GC | 1.14 | 1.19 |
| b3429 | α-Linolenic Acid, C18:3 (c9, c12, c15) | GC | 1.12 | 1.27 |
| YNL241C | α-Linolenic Acid, C18:3 (c9, c12, c15) | GC | 1.12 | 1.13 | for the disclosure of the paragraphs [0499.0.0.6] and [500.0.0.6] see paragraphs [0499.0.0.0] and [0500.0.0.0] above.

Example 15a

Engineering Ryegrass Plants by Over-expressing YNL241C from *Saccharomyces cerevisiae* or Homologs of YNL241C from Other Organisms for the disclosure of the paragraphs [0502.0.0.6] to [508.0.0.6] see paragraphs [0502.0.0.0] to [0508.0.0.0] above.

Example 15b

Engineering Soybean Plants by Over-expressing YNL241C from *Saccharomyces cerevisiae* or Homologs of YNL241C from Other Organisms for the disclosure of the paragraphs [0510.0.0.6] to [513.0.0.6] see paragraphs [0510.0.0.0] to [0513.0.0.0] above.

Example 15c

Engineering Corn Plants by Over-Expressing YNL241C from *Saccharomyces cerevisiae* or Homologs of YNL241C from Other Organisms for the disclosure of the paragraphs [0515.0.0.6] to [540.0.0.6] see paragraphs [0515.0.0.0] to [0540.0.0.0] above.

Example 15d

Engineering Wheat Plants by Over-Expressing YNL241C from *Saccharomyces cerevisiae* or Homologs of YNL241C from Other Organisms for the disclosure of the paragraphs [0542.0.0.6] to [544.0.0.6] see paragraphs [0542.0.0.0] to [0544.0.0.0] above.

Example 15e

Engineering Rapeseed/Canola Plants by Over-Expressing YNL241C from *Saccharomyces cerevisiae* or Homologs of YNL241 C from Other Organisms for the disclosure of the paragraphs [0546.0.0.6] to [549.0.0.6] see paragraphs [0544.0.0.0] to [0549.0.0.0] above.

Example 15f

Engineering Alfalfa Plants by Over-Expressing YNL241C from *Saccharomyces cerevisiae* or Homologs of YNL241 C from Other Organisms for the disclosure of the paragraphs [0551.0.0.6] to [554.0.0.6] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII

TABLE VII

| ORF_NAME | Metabolite | MIN | MAX |
|---|---|---|---|
| b3429 | α-Linolenic Acid, C18:3 (c9, c12, c15) | 1.31 | 1.67 |
| YNL241C | α-Linolenic Acid, C18:3 (c9, c12, c15) | 1.33 | 1.82 |

Table VII shows the increase in α-Linolenic Acid, C18:3 (c9, c12, c15) in genetically modified corn plants expressing the *Saccharomyces cerevisiae* nucleic acid sequence YNL241C and the *E. coli* nucleic acid sequence b3429.

In one embodiment, in case the activity of the *Saccharomyces cerevisiae* protein YNL241C or its homologs, e.g. a "glucose-6-phosphate dehydrogenase", is increased in corn plants, preferably, an increase of the fine chemical α-linolenic acid between 33% and 82% is conferred.

In one embodiment, in case the activity of the *Escherichia coli* protein b3429 or its homologs, e.g. a "glycogen synthase (starch synthase)", is increased in corn plants, preferably, an increase of the fine chemical α-linolenic acid between 31% and 67% is conferred.

for the disclosure of this paragraph see [0554.2.0.0] above.
for the disclosure of this paragraph see [0555.0.0.0] above.
for the disclosure of this paragraph see [0001.0.0.0].

Fatty acids and triglycerides have numerous applications in the food and feed industry, in cosmetics and in the drug sector. Depending on whether they are free saturated or unsaturated fatty acids or triglycerides with an increased content of saturated or unsaturated fatty acids, they are suitable for the most varied applications; thus, for example, polyunsaturated fatty acids (=PUFAs) are added to infant formula to increase its nutritional value. The various fatty acids and triglycerides are mainly obtained from microorganisms such as fungi or from oil-producing plants including phytoplankton and algae, such as soybean, oilseed rape, sunflower and others, where they are usually obtained in the form of their triacylglycerides.

Stearic acid (=octadecanoic acid) is one of the many useful types of saturated fatty acids that come from many animal and vegetable fats and oils. It is a waxy solid that melts at around 70° C. Commonly stearic acid is either prepared by treating animal fat with water at a high pressure and temperature or starting with vegetable oils by hydrogenation of said oils. It is useful as an ingredient in making candles, soaps, and cosmetics and for softening rubber.

Principally microorganisms such as *Mortierella* or oil producing plants such as soybean, rapeseed or sunflower or algae such as Crytocodinium or Phaeodactylum are a common source for oils containing fatty acids, where they are usually obtained in the form of their triacyl glycerides. Alternatively, they are obtained advantageously from animals, such as fish. The free fatty acids are prepared advantageously by hydrolysis with a strong base such as potassium or sodium hydroxide.

for the disclosure of this paragraph see [0005.0.5.5] above.

Unlike most saturated fats, stearic acid does not seem to increase cholesterol levels in the blood, because liver enzymes convert it to an unsaturated fat during digestion.

Stearic acid is the most common one of the long-chain fatty acids. It is found in many foods, such as beef fat, and cocoa butter. It is widely used as mentioned above as a lubricant, in soaps, cosmetics, food packaging, deodorant sticks, toothpastes, and as a softener in rubber.

Encouraging research shows that stearic acid; one of the components of the fat found in the cocoa butter of chocolate, may have some positive effects on platelets. The mechanism believed to be responsible for the potential platelet activation by stearic acid involves Arachidonic metabolism, which includes thromboxane A2, a potent aggregating compound, and prostaglandin I2, a potent anti-aggregating compound.

As described above, fatty acids are used in a lot of different applications, for example in cosmetics, pharmaceuticals and in feed and food.

Therefore improving the productivity of such fatty acids and improving the quality of foodstuffs and animal feeds is an important task of the different industries.

To ensure a high productivity of certain fatty acids in plants or microorganism, it is necessary to manipulate the natural biosynthesis of fatty acids in said organism.

Accordingly, there is still a great demand for new and more suitable genes which encode enzymes which participate in the biosynthesis of fatty acids and make it possible to produce certain fatty acids specifically on an industrial scale without unwanted byproducts forming. In the selection of genes for biosynthesis two characteristics above all are particularly important. On the one hand, there is as ever a need for improved processes for obtaining the highest possible contents of fatty acids on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is stearic acid or triglycerides, lipids, oils or fats containing stearic acid. Accordingly, in the present invention, the term "the fine chemical" as used herein relates to "stearic acid or triglycerides, lipids, oils or fats containing stearic acid". Further, the term "the fine chemicals" as used herein also relates to fine chemicals comprising stearic acid or triglycerides, lipids, oils or fats containing stearic acid.

In one embodiment, the term "the fine chemical" or "the respective fine chemical" means stearic acid or triglycerides, lipids, oils or fats containing stearic acid. Throughout the specification the term "the fine chemical" or "the respective fine chemical" means stearic acid or triglycerides, lipids, oils or fats containing stearic acid, stearic acid and its salts, ester, thioester or stearic acid in free form or bound to other compounds such as triglycerides, glycolipids, phospholipids etc. In a preferred embodiment, the term "the fine chemical" means stearic acid, in free form or its salts or bound to triglycerides. Triglycerides, lipids, oils, fats or lipid mixture thereof shall mean any triglyceride, lipid, oil and/or fat containing any bound or free stearic acid for example sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, or as monoacylglyceride, diacylglyceride or triacylglyceride or other fatty acid esters such as acetyl-Coenzym A thioester, which contain further saturated or unsaturated fatty acids in the fatty acid molecule.

In one embodiment, the term "the fine chemical" and the term "the respective fine chemical" mean at least one chemical compound with an activity of the above-mentioned fine chemical.

Accordingly, the present invention relates to a process for the production of stearic acid, which comprises
(a) increasing or generating the activity of a protein as shown in table II, application no. 8, column 3 encoded by the nucleic acid sequences as shown in table I, application no. 8, column 5, in an organelle of a microorganism or plant, or
(b) increasing or generating the activity of a protein as shown in table II, application no. 8, column 3 encoded by the nucleic acid sequences as shown in table I, application no. 8, column 5 in the plastid of a microorganism or plant, or in one or more parts thereof; and
(c) growing the organism under conditions which permit the production of the fine chemical, thus, stearic acid or fine chemicals comprising stearic acid, in said organism or in the culture medium surrounding the organism.
/
In another embodiment the present invention is related to a process for the production of stearic acid, which comprises
(a) increasing or generating the activity of a protein as shown in table II, application no. 8, column 3 encoded by the nucleic acid sequences as shown in table I, application no. 8, column 5, in an organelle of a non-human organism, or
(b) increasing or generating the activity of a protein as shown in table II, application no. 8, column 3 encoded by the nucleic acid sequences as shown in table I, application no. 8, column 5, which are joined to a nucleic acid sequence encoding a transit peptide in a non-human organism, or in one or more parts thereof; or
(c) increasing or generating the activity of a protein as shown in table II, application no. 8, column 3 encoded by the nucleic acid sequences as shown in table I, application no. 8, column 5, which are joined to a nucleic acid sequence encoding chloroplast localization sequence, in a non-human organism, or in one or more parts thereof, and
(d) growing the organism under conditions which permit the production of stearic acid in said organism.

In another embodiment, the present invention relates to a process for the production of stearic acid, which comprises
(a) increasing or generating the activity of a protein as shown in table II, application no. 8, column 3 encoded by the nucleic acid sequences as shown in table I, application no. 8, column 5, in an organelle of a microorganism or plant through the transformation of the organelle, or
(b) increasing or generating the activity of a protein as shown in table II, application no. 8, column 3 encoded by the nucleic acid sequences as shown in table I, application no. 8, column 5 in the plastid of a microorganism or plant, or in one or more parts thereof through the transformation of the plastids; and
(c) growing the organism under conditions which permit the production of the fine chemical, thus, stearic acid or fine chemicals comprising stearic acid, in said organism or in the culture medium surrounding the organism.

Advantageously the activity of the protein as shown in table II, application no. 8, column 3 encoded by the nucleic acid sequences as shown in table I, application no. 8, column 5 is increased or generated in the abovementioned process in the plastid of a microorganism or plant.

for the disclosure of the paragraphs [0019.0.0.7] to [024.0.0.7] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 8, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 8, column 3 and its homologs as disclosed in table I, application no. 8, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 8, column 3 and its homologs as disclosed in table I, application no. 8, columns 5 and 7.

for the disclosure of the paragraphs [0027.0.0.7] to [029.0.0.7] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 8, columns 5 and 7. The person skilled in the art is able to join said sequences in a functional manner. Advantageously the transit peptide part is cleaved off from the protein part shown in table II, application no. 8, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 8, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 8, columns 5 and 7. In case of the amino acid sequence QIA CSS the three amino acids in front of the start methionine are stemming from the LIC (=ligation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 8, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 8, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 8, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.7] and [0030.3.0.7] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 8, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 8, columns 5 and 7 or a sequence encoding a protein, as depicted in table II, application no. 8, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 8, columns 5 and 7 or a sequence encoding a protein, as depicted in table II, application no. 8, columns 5 and 7 in such a manner that the viroid sequence transports a sequence transcribed from a sequence as depicted in table I, application no. 8, columns 5 and 7 or a sequence encoding a protein as depicted in table II, application no. 8, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 8, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 8, columns 5 and 7.

In a preferred embodiment of the invention the nucleic acid sequences as shown in table I, application no. 8, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 8, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.7] and [032.0.0.7] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 8, column 3. Preferably the modification of the activity of a protein as shown in table II, application no. 8, column 3 or their combination can be achieved by joining the protein to a transit peptide.

Surprisingly it was found, that the transgenic expression of the *Saccaromyces cerevisiae* protein as shown in table II, application no. 8, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of stearic acid and/or triglycerides, lipids, oils and/or fats containing stearic acid, in particular for increasing the amount of stearic acid in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1700 (Accession number NP_416215) from *Escherichia coli* has been published in Blattner et al., Science 277 (5331), 1453-1474 (1997), and its activity is being defined as "putative 4Fe-4S ferredoxin-type protein". Accordingly, in one embodiment, the process of the present invention comprises the use of a "putative 4Fe-4S ferredoxin-type protein" or its homolog, e.g. as shown herein, for the production of the fine chemical, meaning of stearic acid and/or triglycerides, lipids, oils and/or fats containing stearic acid, in particular for increasing the amount of stearic acid in free or bound form in an organism or a part thereof, as mentioned. In one embodiment, in the process of the present invention the activity of a b1700 protein is increased or generated, e.g. from *Escherichia coli* or a homolog thereof, preferably linked at least to one transit peptide as mentioned for example in table V.

In another embodiment, in the process of the present invention the activity of a b1700 protein is increased or generated in a subcellular compartment of the organism or organism cell such as in an organelle like a plastid or mitochondria.

The sequence of b1704 (Accession number NP_416219) from *Escherichia coli* has been published in Blattner et al., Science 277 (5331), 1453-1474 (1997), and its activity is being defined as "3-deoxy-D-arabinoheptulosonate-7-phosphate synthase (DAHP synthetase)". Accordingly, in one embodiment, the process of the present invention comprises the use of a "3-deoxy-D-arabinoheptulosonate-7-phosphate synthase (DAHP synthetase)" or its homolog, e.g. as shown herein, for the production of the fine chemical, meaning of stearic acid and/or triglycerides, lipids, oils and/or fats containing stearic acid, in particular for increasing the amount of stearic acid in free or bound form in an organism or a part thereof, as mentioned. In one embodiment, in the process of the present invention the activity of a b1704 protein is increased or generated, e.g. from *Escherichia coli* or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of YLR099C (Accession number NP_013200) from *Saccharomyces cerevisiae* has been published in Goffeau et al., Science 274 (5287), 546-547, 1996, and its activity is being defined as "putative lipase". Accordingly, in one embodiment, the process of the present invention comprises the use of a "putative lipase" or its homolog, e.g. as shown herein, for the production of the fine chemical, meaning of stearic acid and/or triglycerides, lipids, oils and/or fats containing stearic acid, in particular for increasing the amount of stearic acid in free or bound form in an organism or a part thereof, as mentioned. In one embodiment, in the process of the present invention the activity of a YLR099C protein is increased or generated, e.g. from *Saccharomyces cerevisiae* or a homolog thereof, preferably linked at least to one transit peptide as mentioned for example in table V.

In another embodiment, in the process of the present invention the activity of an YLR099C protein is increased or generated in a subcellular compartment of the organism or organism cell such as in an organelle like a plastid or mitochondria.

In one embodiment, the homolog of the YLR099C, is a homolog having said activity and being derived from Eukaryot. In one embodiment, the homolog of the b1556, b1700 and/or b1704 is a homolog having said activity and being derived from bacteria. In one embodiment, the homolog of the YLR099C is a homolog having said activity and being derived from Fungi. In one embodiment, the homolog of the b1556, b1700 and/or b1704 is a homolog having said activity and being derived from Proteobacteria. In one embodiment, the homolog of the YLR099C is a homolog having said activity and being derived from Ascomycota. In one embodiment, the homolog of the b1556, b1700 and/or b1704 is a homolog having said activity and being derived from Gammaproteobacteria. In one embodiment, the homolog of the YLR099C is a homolog having said activity and being derived from *Saccharomycotina*. In one embodiment, the homolog of the b1556, b1700 and/or b1704 is a homolog having said activity and being derived from Enterobacteriales. In one embodiment, the homolog of the YLR099C is a homolog having said activity and being derived from *Saccharomycetes*. In one embodiment, the homolog of the b1556, b1700 and/or b1704 is a homolog having said activity and being derived from Enterobacteriaceae. In one embodiment, the homolog of the YLR099C is a homolog having said activity and being derived from *Saccharomycetales*. In one embodiment, the homolog of the b1556, b1700 and/or b1704 is a homolog having said activity and being derived from *Escherichia*, preferably from *Escherichia coli*. In one embodiment, the homolog of the YLR099C is a homolog having said activity and being derived from Saccharomycetaceae. In one embodiment, the homolog of the YLR099C is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 8, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 8, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 8, column 3, or which has at least 10% of the original enzymatic activity, preferably 20%, particularly preferably 30%, most particularly preferably 40% in comparison to a protein as shown in table II, application no. 7, column 3 of *Saccharomyces cerevisiae*.

for the disclosure of the paragraphs [0040.0.0.7] to [047.0.0.7] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 8, column 3 its biochemical or genetical causes and the increased amount of the fine chemical.

for the disclosure of the paragraphs [0049.0.0.7] to [051.0.0.7] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 8, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.7] to [058.0.0.7] see paragraphs [0053.0.0.0] to [0058.0.0.0] above.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of stearic acid and/or triglycerides, lipids, oils and/or fats containing stearic acid between 18% and 37% or more is conferred.

In case the activity of the *Escherichia coli* protein b1700 or its homologs, e.g. a "putative 4Fe-4S ferredoxin-type protein" is increased advantageously in an organelle such as a plastid or mitochondria, preferably, in one embodiment an increase of the fine chemical, preferably of stearic acid and/or triglycerides, lipids, oils and/or fats containing stearic acid between 29% and 113% or more is conferred.

In case the activity of the *Escherichia coli* protein b1704 or its homologs, e.g. a "3-deoxy-D-arabinoheptulosonate-7-phosphate synthase (DAHP synthetase)" is increased advantageously in an organelle such as a plastid or mitochondria, preferably, in one embodiment an increase of the fine chemical, preferably of stearic acid and/or triglycerides, lipids, oils and/or fats containing stearic acid between 25% and 153% or more is conferred.

In case the activity of the *Saccharomyces cerevisiae* protein YLR099C or its homologs, e.g. a "putative lipase" is increased advantageously in an organelle such as a plastid or mitochondria, preferably, in one embodiment an increase of the fine chemical, preferably of stearic acid and/or triglycerides, lipids, oils and/or fats containing stearic acid between 16% and 37% or more is conferred.

In case the activity of the *Escherichia coli* proteins b1556, b1700 or b1704 or their homologs," are increased advantageously in an organelle such as a plastid or mitochondria, preferably an increase of the fine chemical stearic acid and/or triglycerides, lipids, oils and/or fats containing stearic acid is conferred.

In case the activity of the *Saccharomyces cerevisiae* protein YLR099C or its homologs, e.g. a "putative lipase" is increased advantageously in an organelle such as a plastid or mitochondria, preferably an increase of the fine chemical stearic acid and/or triglycerides, lipids, oils and/or fats containing stearic acid is conferred.

for the disclosure of the paragraphs [0061.0.0.7] and [062.0.0.7] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 8, column 7 or of the polypeptide as shown in the amino acid sequences as disclosed in table II, application no. 8, columns 5 and 7 or the functional homologues thereof as described herein, or is encoded by the nucleic acid molecule characterized herein or the nucleic acid molecule according to the invention, for example by the nucleic acid molecule as shown in table I, application no. 8, columns 5 and 7 or its herein described functional homologues and has the herein mentioned activity.

For the purposes of the present invention, the term "stearic acid" also encompasses the corresponding salts, such as, for example, the potassium or sodium salts of stearic acid or the salts of stearic acid with amines such as diethylamine as well as triglycerides, lipids, oils and/or fats containing stearic acid.

for the disclosure of the paragraphs [0065.0.0.7] and [066.0.0.7] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 8, columns 5 and 7 or its homologs activity having herein-mentioned stearic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 8, columns 5 and 7, e.g. a nucleic acid sequence encoding a polypeptide having the activity of a protein as indicated in table II, application no. 8, columns 5 and 7 or its homologs activity or of a mRNA encoding the polypeptide of the present invention having herein-mentioned stearic acid increasing activity; and/or c) increasing the specific activity of a protein conferring the increased expression of a protein encoded by the nucleic acid molecule of the invention or of the polypeptide of the present invention having herein-mentioned stearic acid increasing activity, e.g. of a polypeptide having the activity of a protein as indicated in table II, application no. 8, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned stearic acid increasing activity, e.g. of a polypeptide having the activity of a protein as indicated in table II, application no. 8, columns 5 and 7 or its homologs activity; and/or e) stimulating activity of a protein conferring the increased expression of a protein encoded by the nucleic acid molecule of the present invention or a polypeptide of the present invention having herein-mentioned stearic acid increasing activity, e.g. of a polypeptide having the activity of a protein as indicated in table II, application no. 8, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned stearic acid increasing activity, e.g. of a polypeptide having the activity of a protein as indicated in table II, application no. 8, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned stearic acid increasing activity, e.g. of a polypeptide having the activity of a protein as indicated in table II, application no. 8, columns 5 and 7 or its homologs activity; and/or h) increasing the expression of the endogenous gene encoding the polypeptide of the invention, e.g. a polypeptide having the activity of a protein as indicated in table II, application no. 8, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned stearic acid increasing activity, e.g. of polypeptide having the activity of a protein as indicated in table II, application no. 8, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned stearic acid increasing activity, e.g. of a polypeptide having the activity of a protein as indicated in table II, application no. 8, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned stearic acid increasing activity, e.g. of a polypeptide having the activity of a protein as indicated in table II, application no. 8, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 8, column 3 or its homologs. Preferably the increase of the fine chemical takes place in plastids.

for the disclosure of the paragraphs [0069.0.0.7] to [079.0.0.7] see paragraphs [0069.0.0.0] to [0079.0.0.0] above.

The activation of an endogenous polypeptide having above-mentioned activity, e.g. having the activity of a protein as shown in table II, application no. 8, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 8, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 8, column 3. The expression of the chimeric transcription factor in a organism, in particular in a plant, leads to a specific expression of the protein as shown in table II, application no. 8, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.7] to [084.0.0.7] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous fatty acid composition comprising a higher content of (from a viewpoint of nutrional physiology limited) fatty acids, like palmitate and/or palmitoleate.

for the disclosure of this paragraph see paragraph [0086.0.0.0] above.

By influencing the metabolism thus, it is possible to produce, in the process according to the invention, further advantageous compounds. Examples of such compounds are, in addition to stearic acid, triglycerides, lipids, oils and/or fats containing stearic acid compounds such as palmitate and/or palmitoleate.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 8, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound fatty acids, in particular palmitic acid.

for the disclosure of the paragraphs [0090.0.0.7] to [097.0.0.7] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 8, columns 5 and 7 or a derivative thereof, or b) a genetic regulatory element, for example a promoter, which is functionally linked to the nucleic acid sequence as shown table I, application no. 8, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 8, columns 5 and 7 joined to a nucleic acid sequence encoding a transit peptide, or a targeting nucleic acid sequence which directs the nucleic acid sequences disclosed in table I, application no. 8, columns 5 and 7 to the organelle preferentially the plastids. Altenatively the inventive nucleic acids sequences consist advantageously of the nucleic acid sequences as depicted in the sequence protocol and disclosed in table I, application no. 8, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose fatty acid content is modified advantageously owing to the nucleic acid molecule of the present invention expressed. This is important for plant breeders since, for example, the nutritional value of plants for poultry is dependent on the abovementioned essential fatty acids and the general amount of fatty acids as energy source in feed. After the activity of the protein as shown in table II, application no. 8, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.7] to [10.0.0.7] see paragraphs [0102.0.0.0] to [0110.0.0.0] above.

In a preferred embodiment, the fine chemical (stearic acid) is produced in accordance with the invention and, if desired, is isolated. The production of further fatty acids such as palmitic acid and/or palmitoleic acid and/or mixtures thereof or mixtures of other fatty acids by the process according to the invention is advantageous. It may be advantageous to increase the pool of free fatty acids in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example a fatty acid transporter protein or a compound, which functions as a sink for the desired fatty acid for example for stearic acid in the organism is useful to increase the production of the respective fine chemical (see Bao and Ohlrogge, Plant Physiol. 1999 August; 120 (4): 1057-1062). Such fatty acid transporter protein may serve as a link between the location of fatty acid synthesis and the socalled sink tissue, in which fatty acids, triglycerides, oils and fats are stored.

for the disclosure of the paragraphs [0113.0.5.7] to [15.0.5.7] see paragraphs [0113.0.5.5] to [0115.0.5.5] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 8, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 8, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table III, application no. 8, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 8, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 8, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 8, columns 5 and 7 by one or more nucleotides. In one embodiment, the nucleic acid molecule used in the process of the invention does not consist of the sequence indicated in table IA, application no. 8, columns 5 and 7. In one embodiment, the nucleic acid molecule used in the process of the invention is less than 100%, 99.999%, 99.99%, 99.9% or 99% identical to a sequence indicated in table IA, application no. 8, columns 5 and 7. In another embodiment, the nucleic acid molecule does not encode a polypeptide of a sequence indicated in table IIA, application no. 8, columns 5 and 7.

In one embodiment, the nucleic acid molecule used in the process of the invention distinguishes over the sequence indicated in table IB, application no. 8, columns 5 and 7, by one or more nucleotides. In one embodiment, the nucleic acid molecule used in the process of the invention does not consist of the sequence indicated in table IB, application no. 8, columns 5 and 7. In one embodiment, the nucleic acid molecule used in the process of the invention is less than 100%, 99.999%, 99.99%, 99.9% or 99% identical to a sequence indicated in table IB, application no. 8, columns 5 and 7. In another embodiment, the nucleic acid molecule does not encode a polypeptide of a sequence indicated in table IIB, application no. 8, columns 5 and 7.

In one embodiment, the nucleic acid molecule used in the process distinguishes over the sequence shown in table I, application no. 8, columns 5 and 7 by one or more nucleotides or does not consist of the sequence shown in table I, application no. 8, columns 5 and 7. In one embodiment, the nucleic acid molecule of the present invention is less than 100%, 99.999%, 99.99%, 99.9% or 99% identical to the sequence shown in table I, application no. 8, columns 5 and 7. In another embodiment, the nucleic acid molecule does not encode a polypeptide of the sequence shown in table II, application no. 8, columns 5 and 7.

for the disclosure of the paragraphs [0118.0.0.7] to [20.0.0.7] see paragraphs [0118.0.0.0] to [0120.0.0.0] above.

Nucleic acid molecules with the sequence shown in table I, application no. 8, columns 5 and 7, nucleic acid molecules which are derived from the amino acid sequences shown in table II, application no. 8, columns 5 and 7 or from polypeptides comprising the consensus sequence shown in table IV, application no. 8, column 7, or their derivatives or homologues encoding polypeptides with the enzymatic or biological activity of a protein as shown in table II, application no. 8, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 8, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 8, column 3 and conferring the fine chemical increase by expression either in the cytsol or in an organelle such as a plastid or mitochondria or both, preferably in plastids.

for the disclosure of the paragraphs [0126.0.0.7] to [0133.0.0.7] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 8, columns 5 and 7 or the functional homologues thereof as described herein, preferably conferring above-mentioned activity, i.e. conferring the fine chemical increase after increasing its activity, e.g. after increasing the activity of a protein as shown in table II, application no. 8, column 3 by for example expression either in the cytsol or in an organelle such as a plastid or mitochondria or both, preferably in plastids.

for the disclosure of the paragraphs [0135.0.0.7] to [0140.0.0.7] see paragraphs [0135.0.0.0] to [0140.0.0.0] above.

Synthetic oligonucleotide primers for the amplification, e.g. as shown in table III, application no. 8, column 7, by means of polymerase chain reaction can be generated on the basis of a sequence shown herein, for example the sequence shown in table I, application no. 8, columns 5 and 7 or the sequences derived from table II, application no. 8, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 8, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 8, column 3 or further functional homologs of the polypeptide of the invention from other organisms.

for the disclosure of the paragraphs [0144.0.0.7] to [0151.0.0.7] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 8, columns 5 and 7, preferably of table IB, application no. 8, columns 5 and 7 under relaxed hybridization conditions and which code on expression for peptides having the stearic acid, triglycerides, lipids, oils and/or fats containing stearic acid increasing activity.

for the disclosure of the paragraphs [0153.0.0.7] to [0159.0.0.7] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 8, columns 5 and 7, preferably shown in table IB, application no. 8, columns 5 and 7 is one which is sufficiently complementary to one of the nucleotide sequences shown in table I, application no. 8, columns 5 and 7, preferably shown in table IB, application no. 8, columns 5 and 7 such that it can hybridize to one of the nucleotide sequences shown in table I, application no. 8, columns 5 and 7, preferably shown in table IB, application no. 8, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 8, columns 5 and 7, preferably shown in table IB, application no. 8, columns 5 and 7, or a portion thereof and preferably has above mentioned activity, in particular having a fine chemical increasing activity after increasing the activity or an activity of a gene product as shown in table II, application no. 8, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 8, columns 5 and 7, preferably shown in table IB, application no. 8, columns 5 and 7, or a portion thereof and encodes a protein having above-mentioned activity, e.g. conferring of a stearic acid, triglycerides, lipids, oils and/or fats containing stearic acid increase by for example expression either in the cytsol or in an organelle such as a plastid or mitochondria or both, preferably in plastids, and optionally, the activity of a protein as shown in table II, application no. 8, column 3.

Moreover, the nucleic acid molecule of the invention can comprise only a portion of the coding region of one of the sequences shown in table I, application no. 8, columns 5 and 7, preferably shown in table IB, application no. 8, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 8, columns 5 and 7, an anti-sense sequence of one of the sequences, e.g., set forth in table I, application no. 8, columns 5 and 7, preferably shown in table IB, application no. 8, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 8, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 8, columns 5 and 7 such that the protein or portion thereof maintains the ability to participate in the fine chemical production, in particular a stearic acid, triglycerides, lipids, oils and/or fats containing stearic acid increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 8, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 8, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.7] and [0169.0.0.7] see paragraphs [0168.0.0.0] and [0169.0.0.0] above.

The invention further relates to nucleic acid molecules that differ from one of the nucleotide sequences shown in table I, application no. 8, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 8, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 8, columns 5 and 7 or the functional homologues. In a still further embodiment, the nucleic acid molecule of the invention encodes a full length protein which is substantially homologous to an amino acid sequence shown in table II, application no. 8, columns 5 and 7 or the functional homologues. However, in a preferred embodiment, the nucleic acid molecule of the present invention does not consist of the sequence shown in table I, application no. 8, columns 5 and 7, preferably as indicated in table IA, application no. 8, columns 5 and 7. Preferably the nucleic acid molecule of the invention is a functional homologue or identical to a nucleic acid molecule indicated in table IB, application no. 8, columns 5 and 7.

for the disclosure of the paragraphs [0171.0.0.7] to [0173.0.0.7] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 8, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 8, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 8, columns 5 and 7.

for the disclosure of the paragraphs [0179.0.0.7] and [0180.0.0.7] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 8, columns 5 and 7, preferably shown in table IIA, application no. 8, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 8, columns 5 and 7, preferably shown in table IIA, application no. 8, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 8, columns 5 and 7, preferably shown in table IIA, application no. 8, columns 5 and 7, more preferably at least about 70% identical to one of the sequences shown in table II, application no. 8, columns 5 and 7, preferably shown in table IIA, application no. 8, columns 5 and 7, even more preferably at least about 80%, 90%, 95% homologous to the sequence shown in table II, application no. 8, columns 5 and 7, preferably shown in table IIA, application no. 8, columns 5 and 7, and most preferably at least about 96%, 97%, 98%, or 99% identical to the sequence shown in table II, application no. 8, columns 5 and 7, preferably shown in table IIA, application no. 8, columns 5 and 7.

for the disclosure of the paragraphs [0182.0.0.7] to [0188.0.0.7] see paragraphs [0182.0.0.0] to [0188.0.0.0] above.

Functional equivalents derived from one of the polypeptides as shown in table II, application no. 8, columns 5 and 7, preferably shown in table IIB, application no. 8, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 8, columns 5 and 7, preferably shown in table IIB, application no. 8, columns 5 and 7 resp., according to the invention and are distinguished by essentially the same properties as the polypeptide as shown in table II, application no. 8, columns 5 and 7, preferably shown in table IIB, application no. 8, columns 5 and 7.

Functional equivalents derived from the nucleic acid sequence as shown in table I, application no. 8, columns 5 and 7, preferably shown in table IB, application no. 8, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 8, columns 5 and 7, preferably shown in table IIB, application no. 8, columns 5 and 7 resp., according to the invention and encode polypeptides having essentially the same properties as the polypeptide as shown in table II, application no. 8, columns 5 and 7, preferably shown in table IIB, application no. 8, columns 5 and 7.

for the disclosure of this paragraph see paragraph [0191.0.0.0] above.

A nucleic acid molecule encoding an homologous to a protein sequence of table II, application no. 8, columns 5 and 7, preferably shown in table IIB, application no. 8, columns 5 and 7 resp., can be created by introducing one or more nucleotide substitutions, additions or deletions into a nucleotide sequence of the nucleic acid molecule of the present invention, in particular of table I, application no. 8, columns 5 and 7, preferably shown in table IB, application no. 8, columns 5 and 7 resp., such that one or more amino acid substitutions, additions or deletions are introduced into the encoded protein. Mutations can be introduced into the encoding sequences of table I, application no. 8, columns 5 and 7, preferably shown in table IB, application no. 8, columns 5 and 7 resp., by standard techniques, such as site-directed mutagenesis and PCR-mediated mutagenesis.

for the disclosure of the paragraphs [0193.0.0.7] to [0196.0.0.7] see paragraphs [0193.0.0.0] to [0196.0.0.0] above.

Homologues of the nucleic acid sequences used, with the sequence shown in table I, application no. 8, columns 5 and 7, preferably shown in table IB, application no. 8, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 8, columns 5 and 7, preferably shown in table IB, application no. 8, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 8, columns 5 and 7, preferably shown in table IB, application no. 8, columns 5 and 7. It is preferred that the nucleic acid molecule comprises as little as possible other nucleotides not shown in any one of table I, application no. 8, columns 5 and 7, preferably shown in table IB, application no. 8, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 8, columns 5 and 7, preferably shown in table IB, application no. 8, columns 5 and 7.

Also preferred is that the nucleic acid molecule used in the process of the invention encodes a polypeptide comprising the sequence shown in table II, application no. 8, columns 5 and 7, preferably shown in table IIB, application no. 8, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 8, columns 5 and 7, preferably shown in table IIB, application no. 8, columns 5 and 7.

In one embodiment, the nucleic acid molecule of the invention or used in the process encodes a polypeptide comprising the sequence shown in table II, application no. 8, columns 5 and 7, preferably shown in table IIB, application no. 8, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 8, columns 5 and 7, preferably shown in table IB, application no. 8, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 8, columns 5 and 7 expressed under identical conditions.

Homologues of table I, application no. 8, columns 5 and 7 or of the derived sequences of table II, application no. 8, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.7] to [0215.0.0.7] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 8, columns 5 and 7, preferably in table II B, application no. 8, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 8, columns 5 and 7, preferably in table IB, application no. 8, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying a cDNA library or a genomic library using the primers in table III, application no. 8, column 7 and conferring an increase in the amount of the fine chemical in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising the consensus sequence shown in table IV, application no. 8, column 7 and conferring an increase in the amount of the fine chemical in an organism or a part thereof;
k) nucleic acid molecule encoding the amino acid sequence of a polypeptide encoding a domain of the polypeptide shown in table II, application no. 8, columns 5 and 7 and conferring an increase in the amount of the fine chemical in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 8, columns 5 and 7 or a nucleic acid molecule encoding, preferably at least the mature form of, the polypeptide shown in table II, application no. 8, columns 5 and 7, and conferring an increase in the amount of the fine chemical in an organism or a part thereof; or which encompasses a sequence which is complementary thereto;
whereby, preferably, the nucleic acid molecule according to (a) to (l) distinguishes over the sequence depicted in table I A and/or I B, application no. 8, columns 5 and 7 by one or more nucleotides. In one embodiment, the nucleic acid molecule of the invention does not consist of the sequence shown in table I A and/or I B, application no. 8, columns 5 and 7. In another embodiment, the nucleic acid molecule of the present invention is at least 30% identical and less than 100%, 99.999%, 99.99%, 99.9% or 99% identical to the sequence shown in table I A and/or I B, application no. 8, columns 5 and 7. In a further embodiment the nucleic acid molecule does not encode the polypeptide sequence shown in table II A and/or II B, application no. 8, columns 5 and 7. Accordingly, in one embodiment, the nucleic acid molecule of the present invention encodes in one embodiment a polypeptide which differs at least in one or more amino acids from the polypeptide shown in table II A and/or II B, application no. 8, columns 5 and 7 does not encode a protein of the sequence shown in table II A and/or II B, application no. 8, columns 5 and 7. Accordingly, in one embodiment, the protein encoded by a sequence of a nucleic acid accoriding to (a) to (l) does not consist of the sequence shown in table IA and/or IB, application no. 8, columns 5 and 7. In a further embodiment, the protein of the present invention is at least 30% identical to protein sequence depicted in table IIA and/or IIB, application no. 8, columns 5 and 7 and less than 100%, preferably less than 99.999%, 99.99% or 99.9%, more preferably less than 99%, 985, 97%, 96% or 95% identical to the sequence shown in table IIA and/or IIB, application no. 8, columns 5 and 7.

for the disclosure of the paragraphs [0217.0.0.7] to [0226.0.0.7] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 8, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.7] to [0239.0.0.7] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorgansms.

In addition to the sequence mentioned in Table I, application no. 8, columns 5 and 7 or its derivatives, it is advantageous additionally to express and/or mutate further genes in the organisms. Especially advantageously, additionally at least one further gene of the fatty acid biosynthetic pathway such as for palmitate, palmitoleate, stearate and/or oleate is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 8, columns 5 and 7 with genes which generally support or enhances to growth or yield of the target organisms, for example genes which lead to faster growth rate of microorganisms or genes which produces stress-, pathogen, or herbicide resistant plants.

for the disclosure of the paragraphs [0241.0.5.7] and [0242.0.5.7] see paragraphs [0241.0.5.5] and [0242.0.5.5] above.

In a further advantageous embodiment of the process of the invention, the organisms used in the process are those in which simultaneously a stearic acid degrading protein is attenuated, in particular by reducing the rate of expression of the corresponding gene.

for the disclosure of this paragraph see paragraph [0242.2.5.5] above.

for the disclosure of the paragraphs [0243.0.0.7] to [0264.0.0.7] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 8, columns 5 and 7 and described herein to achieve an expression in one of said compartments or extracellular.

for the disclosure of the paragraphs [0266.0.0.7] to [0287.0.0.7] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 8, columns 5 and 7 or their homologs is functionally linked to a plastidial targeting sequence. A further preferred embodiment of the invention relates to a vector in which a nucleic acid sequence encoding one of the polypeptides shown in table II, application no. 8, columns 5 and 7 or their homologs is functionally linked to a regulatory sequences which permit the expression in plastids.

for the disclosure of the paragraphs [0289.0.0.7] to [0296.0.0.7] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b1556, anti-b1700, anti-b1704 and/or anti-YLR099C protein antibody or an antibody against polypeptides as shown in table II, application no. 8, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 8, columns 5 and 7 or as coded by the nucleic acid molecule shown in table I, application no. 8, columns 5 and 7 or functional homologues thereof.

In one advantageous embodiment, in the method of the present invention the activity of a polypeptide is increased comprising or consisting of the consensus sequence shown in table IV, application no. 8, columns 7 and in one another embodiment, the present invention relates to a polypeptide comprising or consisting of the consensus sequence shown in table IV, application no. 8, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.7] to [0304.0.0.7] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 8, columns 5 and 7 by one or more amino acids. In one embodiment, polypeptide distinguishes form the sequence shown in table IIA and/or IIB, application no. 8, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 8, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 8, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 8, columns 5 and 7 by one or more amino acids. In another embodiment, said polypeptide of the invention does not consist of the sequence shown in table IIA and/or IIB, application no. 8, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 8, columns 5 and 7.

In one embodiment, the present invention relates to a polypeptide having the activity of the protein as shown in table IIA and/or IIB, application no. 8, column 3, which distinguishes over the sequence depicted in table IIA and/or IIB, application no. 8, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.7] to [0311.0.0.7] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table 11, application no. 8, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 8, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 8, columns 5 and 7 or which is homologous thereto, as defined above.

Accordingly the polypeptide of the present invention can vary from the sequences shown in table IIA and/or IIB, application no. 8, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 8, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 8, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 8, column 3. Differences shall mean at least one amino acid different from the sequences as shown in table II, application no. 8, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 8, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 8, column 3. The nucleic acid molecules and polypeptide molecules of the invention are expressed such that the yield, production, and/or efficiency of production of a desired compound is improved.

for the disclosure of the paragraphs [0320.0.0.7] to [0322.0.0.7] see paragraphs [0320.0.0.0] to [0322.0.0.0] above.

In one embodiment, a protein (=polypeptide) as shown in table II, application no. 8, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 8, column 3, e.g., a protein which does not confer the activity described herein and which is derived from the same or a different organism.

for the disclosure of the paragraphs [0324.0.0.7] to [0329.0.0.7] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 8, columns 5 and 7.

for the disclosure of the paragraphs [0331.0.0.7] to [0346.0.0.7] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 8, column 3. Due to the above mentioned activity the fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 8, column 3 or a protein as shown in table II, application no. 8, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 8, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.7] to [0358.0.0.7] and [0359.0.5.7] see paragraphs [0350.0.0.0] to [0358.0.0.0] and [0359.0.5.5] above.

for the disclosure of the paragraphs [0360.0.0.7] to [0362.0.0.7] see paragraphs [0360.0.0.0] to [0362.0.0.0] above.

for the disclosure of the paragraphs [0363.0.5.7] to [0365.0.5.7] see paragraphs [0363.0.5.5] to [0365.0.5.5] above.

for the disclosure of the paragraphs [0366.0.0.7] to [0369.0.0.7] see paragraphs [0366.0.0.0] to [0369.0.0.0] above.

The fermentation broths obtained in this way, containing in particular stearic acid, triglycerides, lipids, oils and/or fats containing stearic acid, normally have a dry matter content of from 7.5 to 25% by weight. The fermentation broth can be processed further. Depending on requirements, the biomass can be separated, such as, for example, by centrifugation, filtration, decantation or a combination of these methods, from the fermentation broth or left completely in it. Afterwards the biomass can be extracted without any further process steps or disrupted and then extracted. If necessary the fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction.

for the disclosure of this paragraph see paragraph [0371.0.5.5] above.

for the disclosure of the paragraphs [0372.0.0.7] to [0376.0.0.7], [0376.1.0.7] and [0377.0.0.7] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 8, columns 5 and 7, preferably in table IB, application no. 8, columns 5 and 7, and, optionally, isolating the full length cDNA clone or complete genomic clone;

(c) introducing the candidate nucleic acid molecules in host cells, preferably in a plant cell or a microorganism, appropriate for producing the fine chemical;

(d) expressing the identified nucleic acid molecules in the host cells;

(e) assaying the fine chemical level in the host cells; and (f) identifying the nucleic acid molecule and its gene product which expression confers an increase in the fine chemical level in the host cell after expression compared to the wild type.

for the disclosure of the paragraphs [0379.0.0.7] to [0383.0.0.7] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 8, column 3, e.g. comparing near identical organisms with low and high activity of the proteins as shown in table II, application no. 8, column 3.

for the disclosure of the paragraphs [0385.0.0.7] to [0404.0.0.7] see paragraphs [0385.0.0.0] to [0404.0.0.0] above.

for the disclosure of this paragraph see paragraph [0405.0.5.5] above.

for the disclosure of the paragraphs [0406.0.0.7] to [0435.0.0.7] see paragraphs [0406.0.0.0] to [0435.0.0.0] above.

stearic acid, triglycerides, lipids, oils and/or fats containing stearic acid production in *Mortierella*

The fatty acid production can be analysed as mentioned above. The proteins and nucleic acids can be analysed as mentioned below.

for the disclosure of the paragraphs [0437.0.0.7] and [0438.0.0.7] see paragraphs [0437.0.0.0] and [0438.0.0.0] above.

for the disclosure of the paragraphs [0439.0.5.7] and [0440.0.5.7] see paragraphs [0439.0.5.5] and [0440.0.5.5] above.

for the disclosure of this paragraph see [0441.0.0.0] above.

for the disclosure of the paragraphs [0442.0.5.7] and [0445.0.5.7] see paragraphs [0442.0.5.5] and [0445.0.5.5] above.

for the disclosure of the paragraphs [0446.0.0.7] to [0497.0.0.7] see paragraphs [0446.0.0.0] to [0497.0.0.0] above.

The results of the different plant analyses can be seen from the table, which follows:

TABLE VI

| ORF | Metabolite | Method | Min | Max |
|---|---|---|---|---|
| b1556 | stearic acid (C18:0) | GC | 1.18 | 1.37 |
| b1700 | stearic acid (C18:0) | GC | 1.29 | 2.13 |
| b1704 | stearic acid (C18:0) | GC | 1.25 | 2.53 |
| YLR099C | stearic acid (C18:0) | GC | 1.16 | 1.37 | for the disclosure of the paragraphs [0499.0.0.7] and [0500.0.0.7] see paragraphs [0499.0.0.0] and [0500.0.0.0] above.

Example 15a

Engineering Ryegrass Plants by Over-expressing YLR099C from *Saccharomyces cerevisiae* or Homologs of YLR099C from Other Organisms for the disclosure of the paragraphs [0502.0.0.7] to [0508.0.0.7] see paragraphs [0502.0.0.0] to [0508.0.0.0] above.

Example 15b

Engineering Soybean Plants by Over-expressing YLR099C from *Saccharomyces cerevisiae* or Homologs of YLR099C from Other Organisms for the disclosure of the paragraphs [0510.0.0.7] to [0513.0.0.7] see paragraphs [0510.0.0.0] to [0513.0.0.0] above.

Example 15c

Engineering Corn Plants by Over-expressing YLR099C from *Saccharomyces cerevisiae* or Homologs of YLR099C from Other Organisms for the disclosure of the paragraphs [0515.0.0.7] to [0540.0.0.7] see paragraphs [0515.0.0.0] to [0540.0.0.0] above.

Example 15d

Engineering Wheat Plants by Over-expressing YLR099C from *Saccharomyces cerevisiae* or Homologs of YLR099C from Other Organisms for the disclosure of the paragraphs [0542.0.0.7] to [0544.0.0.7] see paragraphs [0542.0.0.0] to [0544.0.0.0] above.

Example 15e

Engineering Rapeseed/Canola Plants by Over-expressing YLR099C from *Saccharomyces cerevisiae* or Homologs of YLR099C from Other Organisms for the disclosure of the paragraphs [0546.0.0.7] to [0549.0.0.7] see paragraphs [0544.0.0.0] to [0549.0.0.0] above.

Example 15f

Engineering Alfalfa Plants by Over-expressing YLR099C from *Saccharomyces cerevisiae* or Homologs of YLR099C from Other Organisms for the disclosure of the paragraphs [0551.0.0.7] to [0554.0.0.7] see paragraphs [0551.0.0.0] to [0554.0.0.0] above.

% for the disclosure of this paragraph see [0554.2.0.0] above.
for the disclosure of this paragraph see [0555.0.0.0] above.
for the disclosure of this paragraph see [0001.0.0.0].
for the disclosure of this paragraph see [0002.0.7.7] above.

Palmitic acid is a major component for manufacturing of soaps, lubricating oils and waterproofing materials. Furthermore it is used for the synthesis of metallic palmitates. Additional applications are as food additive and in the synthesis of food-grade additives; as a constituent of cosmetic formulations. Palmitic acid is a major component of many natural fats and oils in the form of a glyceryl ester, e.g. palm oil, and in most commercial-grade stearic acid products.

for the disclosure of the paragraph [0004.0.7.8] see paragraph [0004.0.7.7] above.

for the disclosure of this paragraph see [0005.0.5.5] above.

Palmitic acid is as mentioned above the major fat in meat and dairy products.

Further uses or palmitic acid are as food ingredients raw material for emulsifiers or personal care emulsifier for facial creams and lotions. Palmitic acid is also used in shaving cream formulations, waxes or fruit wax formulations.

Palmitic acid is also used in shaving cream formulations, waxes or fruit wax formulations.

for the disclosure of the paragraphs [0009.0.8.8] to [0012.0.8.8] see paragraphs [0009.0.7.7] and [0012.0.7.7] above for the disclosure of this paragraph see [0013.0.0.0] above.

Accordingly, in a first embodiment, the invention relates to a process for the production of a fine chemical, whereby the fine chemical is palmitic acid or triglycerides, lipids, oils or fats containing palmitic acid. Accordingly, in the present invention, the term "the fine chemical" as used herein relates to "palmitic acid or triglycerides, lipids, oils or fats containing palmitic acid". Further, the term "the fine chemicals" as used herein also relates to fine chemicals comprising palmitic acid or triglycerides, lipids, oils or fats containing palmitic acid.

In one embodiment, the term "the fine chemical" or "the respective fine chemical" means palmitic acid or triglycerides, lipids, oils or fats containing palmitic acid. Throughout the specification the term "the fine chemical" or "the respective fine chemical" means palmitic acid or triglycerides, lipids, oils or fats containing palmitic acid, palmitic acid and its salts, ester, thioester or palmitic acid in free form or bound to other compounds such as triglycerides, glycolipids, phospholipids etc. In a preferred embodiment, the term "the fine chemical" means palmitic acid, in free form or its salts or bound to triglycerides. Triglycerides, lipids, oils, fats or lipid mixture thereof shall mean any triglyceride, lipid, oil and/or fat containing any bound or free palmitic acid for example sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, or as monoacylglyceride, diacylglyceride or triacylglyceride or other fatty acid esters such as acetyl-Coenzym A thioester, which contain further saturated or unsaturated fatty acids in the fatty acid molecule.

In one embodiment, the term "the fine chemical" and the term "the respective fine chemical" mean at least one chemical compound with an activity of the above-mentioned fine chemical.

Accordingly, the present invention relates to a process for the production of palmitic acid, which comprises
(a) increasing or generating the activity of a protein as shown in table II, application no. 9, column 3 encoded by the nucleic acid sequences as shown in table I, application no. 9, column 5, in an organelle of a microorganism or plant, or
(b) increasing or generating the activity of a protein as shown in table II, application no. 9, column 3 encoded by the nucleic acid sequences as shown in table I, application no. 9, column 5 in the plastid of a microorganism or plant, or in one or more parts thereof; and
(c) growing the organism under conditions which permit the production of the fine chemical, thus, palmitic acid or fine chemicals comprising palmitic acid, in said organism or in the culture medium surrounding the organism.

/

In another embodiment the present invention is related to a process for the production of palmitic acid, which comprises
(a) increasing or generating the activity of a protein as shown in table II, application no. 9, column 3 encoded by the nucleic acid sequences as shown in table I, application no. 9, column 5, in an organelle of a non-human organism, or
(b) increasing or generating the activity of a protein as shown in table II, application no. 9, column 3 encoded by the nucleic acid sequences as shown in table I, application no. 9, column 5, which are joined to a nucleic acid sequence encoding a transit peptide in a non-human organism, or in one or more parts thereof; or
(c) increasing or generating the activity of a protein as shown in table II, application no. 9, column 3 encoded by the nucleic acid sequences as shown in table I, application no. 9, column 5, which are joined to a nucleic acid sequence encoding chloroplast localization sequence, in a non-human organism, or in one or more parts thereof, and
(d) growing the organism under conditions which permit the production of palmitic acid in said organism.

In another embodiment, the present invention relates to a process for the production of palmitic acid, which comprises
(a) increasing or generating the activity of a protein as shown in table II, application no. 9, column 3 encoded by the nucleic acid sequences as shown in table I, application no. 9, column 5, in an organelle of a microorganism or plant through the transformation of the organelle, or
(b) increasing or generating the activity of a protein as shown in table II, application no. 9, column 3 encoded by the nucleic acid sequences as shown in table I, application no. 9, column 5 in the plastid of a microorganism or plant, or in one or more parts thereof through the transformation of the plastids; and
(c) growing the organism under conditions which permit the production of the fine chemical, thus, palmitic acid or fine chemicals comprising palmitic acid, in said organism or in the culture medium surrounding the organism.

Advantageously the activity of the protein as shown in table II, application no. 9, column 3 encoded by the nucleic acid sequences as shown in table I, application no. 9, column 5 is increased or generated in the abovementioned process in the plastid of a microorganism or plant.

for the disclosure of the paragraphs [0019.0.0.8] to [0024.0.0.8] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 9, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δsubunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 9, column 3 and its homologs as disclosed in table I, application no. 9, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 9, column 3 and its homologs as disclosed in table I, application no. 9, columns 5 and 7.

for the disclosure of the paragraphs [0027.0.0.8] to [0029.0.0.8] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 9, columns 5 and 7. The person skilled in the art is able to join said sequences in a functional manner. Advantageously the transit peptide part is cleaved off from the protein part shown in table II, application no. 9, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 9, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 9, columns 5 and 7. In case of the amino acid sequence QIA CSS the three amino acids in front of the start methionine are stemming from the LIC (=ligatation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 9, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 9, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 9, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.8] and [0030.3.0.8] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 9, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 9, columns 5 and 7 or a sequence encoding a protein, as depicted in table II, application no. 9, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 9, columns 5 and 7 or a sequence encoding a protein, as depicted in table II, application no. 9, columns 5 and 7 in such a manner that the viroid sequence transports a sequence transcribed from a sequence as depicted in table I, application no. 9, columns 5 and 7 or a sequence encoding a protein as depicted in table II, application no. 9, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 9, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 9, columns 5 and 7.

In a preferred embodiment of the invention the nucleic acid sequences as shown in table I, application no. 9, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 9, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.8] and [0032.0.0.8] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 9, column 3. Preferably the modification of the activity of a protein as shown in table II, application no. 9, column 3 or their combination can be achieved by joining the protein to a transit peptide.

Surprisingly it was found, that the transgenic expression of the Saccaromyces cerevisiae protein as shown in table II, application no. 9, column 3 in plastids of a plant such as Arabidopsis thaliana for example through the linkage to at least one targeting sequence for example as mentioned in table V conferred an increase in the fine chemical content of the transformed plants.

for the disclosure of this paragraph see paragraph [0035.0.0.0] above.

The sequence of b0403 (Accession numberPIR:C64769) from Escherichia coli has been published in Blattner et al., Science 277 (5331), 1453-1474 (1997), and its activity is being defined as "maltodextrin glucosidase". Accordingly, in one embodiment, the process of the present invention comprises the use of a "maltodextrin glucosidase" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b0403 protein is increased or generated, e.g. from Escherichia coli or a homolog thereof, preferably linked at least to one transit peptide as mentioned for example in table V.

In another embodiment, in the process of the present invention the activity of a b0403 protein is increased or generated in a subcellular compartment of the organism or organism cell such as in an organelle like a plastid or mitochondria.

The sequence of b0488 (Accession number NP_415021) from Escherichia coli has been published in Blattner et al., Science 277 (5331), 1453-1474 (1997). Accordingly, in one embodiment, the process of the present invention comprises the use of its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b0488 protein is increased or generated, e.g. from Escherichia coli or a homolog thereof, preferably linked at least to one transit peptide as mentioned for example in table V.

In another embodiment, in the process of the present invention the activity of a b0488 protein is increased or generated in a subcellular compartment of the organism or organism cell such as in an organelle like a plastid or mitochondria.

The sequence of b1095 (Accession number NP_415613) from Escherichia coli has been published in Blattner et al., Science 277 (5331), 1453-1474 (1997), and its activity is being defined as "3-oxoacyl-[acyl-carrier-protein] synthase II". Accordingly, in one embodiment, the process of the present invention comprises the use of a "3-oxoacyl-[acyl-carrier-protein] synthase II" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b1095 protein is increased or generated, e.g. from Escherichia coli or a homolog thereof, preferably linked at least to one transit peptide as mentioned for example in table V.

In another embodiment, in the process of the present invention the activity of a b1095 protein is increased or generated in a subcellular compartment of the organism or organism cell such as in an organelle like a plastid or mitochondria.

The sequence of b1410 (Accession number NP_415928) from Escherichia coli has been published in Blattner et al., Science 277 (5331), 1453-1474 (1997), and its activity is being defined as "putative methylase with S-adenosyl-L-methionine-dependent methyltransferase domain and alpha/beta-hydrolase domain". Accordingly, in one embodiment, the process of the present invention comprises the use of a "putative methylase with S-adenosyl-L-methionine-dependent methyltransferase domain and alpha/beta-hydrolase domain" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b1410 protein is increased or generated, e.g. from Escherichia coli or a homolog thereof, preferably linked at least to one transit peptide as mentioned for example in table V.

In another embodiment, in the process of the present invention the activity of a b1410 protein is increased or generated in a subcellular compartment of the organism or organism cell such as in an organelle like a plastid or mitochondria.

The sequence of b1627 (Accession number: NP_416144) from Escherichia coli has been published in Blattner et al., Science 277 (5331), 1453-1474 (1997), and its activity is being defined as "putative oxidoreductase, inner membrane protein". Accordingly, in one embodiment, the process of the present invention comprises the use of a "putative oxidoreductase, inner membrane protein" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b1627 protein is increased or generated, e.g. from *Escherichia coli* or a homolog thereof, preferably linked at least to one transit peptide as mentioned for example in table V.

In another embodiment, in the process of the present invention the activity of a b1627 protein is increased or generated in a subcellular compartment of the organism or organism cell such as in an organelle like a plastid or mitochondria.

The sequence of b1758 (Accession number NP_416272) from *Escherichia coli* has been published in Blattner et al., Science 277 (5331), 1453-1474 (1997), and its activity is being defined as "putative cytochrome oxidase". Accordingly, in one embodiment, the process of the present invention comprises the use of a "putative cytochrome oxidase" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b1758 protein is increased or generated, e.g. from *Escherichia coli* or a homolog thereof, preferably linked at least to one transit peptide as mentioned for example in table V.

In another embodiment, in the process of the present invention the activity of a b1758 protein is increased or generated in a subcellular compartment of the organism or organism cell such as in an organelle like a plastid or mitochondria.

The sequence of b1980 (Accession number F64962) from *Escherichia coli* has been published in Blattner et al., Science 277 (5331), 1453-1474 (1997), and its activity is being defined as "putative transport protein". Accordingly, in one embodiment, the process of the present invention comprises the use of a "putative transport protein" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b1980 protein is increased or generated, e.g. from *Escherichia coli* or a homolog thereof, preferably linked at least to one transit peptide as mentioned for example in table V.

In another embodiment, in the process of the present invention the activity of a b1980 protein is increased or generated in a subcellular compartment of the organism or organism cell such as in an organelle like a plastid or mitochondria.

The sequence of b2066 (Accession number NP_416570) from *Escherichia coli* has been published in Blattner et al., Science 277 (5331), 1453-1474 (1997), and its activity is being defined as "uridine/cytidine kinase". Accordingly, in one embodiment, the process of the present invention comprises the use of a "uridine/cytidine kinase" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b2066 protein is increased or generated, e.g. from *Escherichia coli* or a homolog thereof, preferably linked at least to one transit peptide as mentioned for example in table V.

In another embodiment, in the process of the present invention the activity of a b2066 protein is increased or generated in a subcellular compartment of the organism or organism cell such as in an organelle like a plastid or mitochondria.

The sequence of b2223 (Accession number NP_416727) from *Escherichia coli* has been published in Blattner et al., Science 277 (5331), 1453-1474 (1997), and its activity is being defined as "short chain fatty acid transporter". Accordingly, in one embodiment, the process of the present invention comprises the use of a "short chain fatty acid transporter" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a b2223 protein is increased or generated, e.g. from *Escherichia coli* or a homolog thereof, preferably linked at least to one transit peptide as mentioned for example in table V.

In another embodiment, in the process of the present invention the activity of a b2223 protein is increased or generated in a subcellular compartment of the organism or organism cell such as in an organelle like a plastid or mitochondria.

The sequence of YLR099C (Accession number NP_013200NP_014158) from *Saccharomyces cerevisiae* has been published in Goffeau et al., Science 274 (5287), 546-547, 1996, and its activity is being defined as "putative lipase". Accordingly, in one embodiment, the process of the present invention comprises the use of a "putative lipase" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a YLR099C protein is increased or generated, e.g. from *Saccharomyces cerevisiae* or a homolog thereof, preferably linked at least to one transit peptide as mentioned for example in table V.

In another embodiment, in the process of the present invention the activity of an YLR099C protein is increased or generated in a subcellular compartment of the organism or organism cell such as in an organelle like a plastid or mitochondria.

The sequence of YPR035W (Accession number NP_015360) from *Saccharomyces cerevisiae* has been published in Goffeau et al., Science 274 (5287), 546-547, 1996, and its activity is being defined as "glutamine synthetase". Accordingly, in one embodiment, the process of the present invention comprises the use of a "glutamine synthetase" or its homolog, e.g. as shown herein, for the production of the fine chemical, meaning of palmitic acid and/or triglycerides, lipids, oils and/or fats containing palmitic acid, in particular for increasing the amount of palmitic acid in free or bound form in an organism or a part thereof, as mentioned. In one embodiment, in the process of the present invention the activity of a YPR035W protein is increased or generated, e.g. from *Saccharomyces cerevisiae* or a homolog thereof, preferably linked at least to one transit peptide as mentioned for example in table V.

In another embodiment, in the process of the present invention the activity of an YPR035W protein is increased or generated in a subcellular compartment of the organism or organism cell such as in an organelle like a plastid or mitochondria.

In one embodiment, the homolog of the YLR099C or YPR035W, is a homolog having said activity and being derived from Eukaryot. In one embodiment, the homolog of the b0403, b0488, b1410, b1627, b1758, b1980, b2066, b2223 and/or b1095 is a homolog having said activity and being derived from bacteria. In one embodiment, the homolog of the YLR099C or YPR035W is a homolog having said activity and being derived from Fungi. In one embodiment, the homolog of the b0403, b0488, b1410, b1627, b1758, b1980, b2066, b2223 and/or b1095 is a homolog having said activity and being derived from Proteobacteria. In one embodiment, the homolog of the YLR099C or YPR035W is a homolog having said activity and being derived from Ascomycota. In one embodiment, the homolog of the b0403, b0488, b1410, b1627, b1758, b1980, b2066, b2223 and/or b1095 is a homolog having said activity and being derived from Gammaproteobacteria. In one embodiment, the homolog of the YLR099C or YPR035W is a homolog having said activity and being derived from *Saccharomycotina*. In one embodiment, the homolog of the b0403, b0488, b1410, b1627, b1758, b1980, b2066, b2223 and/or b1095 is a homolog having said activity and being derived from Enterobacteriales. In one embodiment, the homolog of the YLR099C or YPR035W is a homolog having said activity and being derived from *Saccharomycetes*. In one embodiment, the homolog of the b0403, b0488, b1410, b1627, b1758, b1980, b2066, b2223 and/or b1095 is a homolog having said activity and being derived from Enterobacteriaceae. In one embodiment, the homolog of the YLR099C or YPR035W is a homolog having said activity and being derived from *Saccharomycetales*. In one embodiment, the homolog of the b0403, b0488, b1410, b1627, b1758, b1980, b2066, b2223 and/or b1095 is a homolog having said activity and being derived from *Escherichia*, preferably from *Escherichia coli*. In one embodiment, the homolog of the YLR099C or YPR035W is a homolog having said activity and being derived from Saccharomycetaceae. In one embodiment, the homolog of the YLR099C or YPR035W is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 9, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 9, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 9, column 3, or which has at least 10% of the original enzymatic activity, preferably 20%, particularly preferably 30%, most particularly preferably 40% in comparison to a protein as shown in table II, application no. 7, column 3 of *Saccharomyces cerevisiae*.

for the disclosure of the paragraphs [0040.0.0.8] to [0047.0.0.8] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 9, column 3 its biochemical or genetical causes and the increased amount of the fine chemical.

for the disclosure of the paragraphs [0049.0.0.8] to [0051.0.0.8] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 9, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modifiy the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.8] to [0058.0.0.8] see paragraphs [0053.0.0.0] to [0058.0.0.0] above.

In case the activity of the *Escherichia coli* protein b0403 or its homologs, e.g. a "maltodextrin glucosidase" is increased advantageously in an organelle such as a plastid or mitochondria, preferably, in one embodiment an increase of the fine chemical, preferably of palmitic acid and/or triglycerides, lipids, oils and/or fats containing palmitic acid between 21% and 40% or more is conferred.

In case the activity of the *Escherichia coli* protein b0488 or its homologs is increased advantageously in an organelle such as a plastid or mitochondria, preferably, in one embodiment an increase of the fine chemical, preferably of palmitic acid and/or triglycerides, lipids, oils and/or fats containing palmitic acid between 16% and 43% or more is conferred.

In case the activity of the *Escherichia coli* protein b1095 or its homologs, e.g. a "3-oxoacyl-[acyl-carrier-protein] synthase II" is increased advantageously in an organelle such as a plastid or mitochondria, preferably, in one embodiment an increase of the fine chemical, preferably of palmitic acid and/or triglycerides, lipids, oils and/or fats containing palmitic acid between 16% and 47% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased advantageously in an organelle such as a plastid or mitochondria, preferably, in one embodiment an increase of the fine chemical, preferably of palmitic acid and/or triglycerides, lipids, oils and/or fats containing palmitic acid between 28% and 41% or more is conferred.

In case the activity of the *Escherichia coli* protein b1627 or its homologs, e.g. a "putative oxidoreductase, inner membrane protein" is increased advantageously in an organelle such as a plastid or mitochondria, preferably, in one embodiment an increase of the fine chemical, preferably of palmitic acid and/or triglycerides, lipids, oils and/or fats containing palmitic acid between 16% and 24% or more is conferred.

In case the activity of the *Escherichia coli* protein b1758 or its homologs, e.g. a "putative cytochrome oxidase" is increased advantageously in an organelle such as a plastid or mitochondria, preferably, in one embodiment an increase of the fine chemical, preferably of palmitic acid and/or triglycerides, lipids, oils and/or fats containing palmitic acid between 16% and 29% or more is conferred.

In case the activity of the *Escherichia coli* protein b1980 or its homologs, e.g. a "putative transport protein" is increased advantageously in an organelle such as a plastid or mitochondria, preferably, in one embodiment an increase of the fine chemical, preferably of palmitic acid and/or triglycerides, lipids, oils and/or fats containing palmitic acid between 16% and 33% or more is conferred.

In case the activity of the *Escherichia coli* protein b2066 or its homologs, e.g. a "uridine/cytidine kinase" is increased advantageously in an organelle such as a plastid or mitochondria, preferably, in one embodiment an increase of the fine chemical, preferably of palmitic acid and/or triglycerides, lipids, oils and/or fats containing palmitic acid between 19% and 46% or more is conferred.

In case the activity of the *Escherichia coli* protein b2233 or its homologs, e.g. a "short chain fatty acid transporter" is increased advantageously in an organelle such as a plastid or mitochondria, preferably, in one embodiment an increase of the fine chemical, preferably of palmitic acid and/or triglycerides, lipids, oils and/or fats containing palmitic acid between 17% and 89% or more is conferred.

In case the activity of the *Saccharomyces cerevisiae* protein YLR099C or its homologs, e.g. a putative lipase" is increased advantageously in an organelle such as a plastid or mitochondria, preferably, in one embodiment an increase of the fine chemical, preferably of palmitic acid and/or triglycerides, lipids, oils and/or fats containing palmitic acid between 15% and 50% or more is conferred.

In case the activity of the *Saccharomyces cerevisiae* protein YPR035W or its homologs, e.g. a "glutamine synthetase" is increased advantageously in an organelle such as a plastid or mitochondria, preferably, in one embodiment an increase of the fine chemical, preferably of palmitic acid and/or triglycerides, lipids, oils and/or fats containing palmitic acid between 25% and 60% or more is conferred.

In case the activity of the *Escherichia coli* proteins b0403, b0488, b1410, b1627, b1758, b1980, b2066, b2223 or b1095 or their homologs," are increased advantageously in an organelle such as a plastid or mitochondria, preferably an increase of the fine chemical palmitic acid and/or triglycerides, lipids, oils and/or fats containing palmitic acid is conferred.

In case the activity of the *Saccharomyces cerevisiae* protein YLR099C or YPR035W or its homologs is increased advantageously in an organelle such as a plastid or mitochondria, preferably an increase of the fine chemical palmitic acid and/or triglycerides, lipids, oils and/or fats containing palmitic acid is conferred.

for the disclosure of the paragraphs [0061.0.0.8] and [0062.0.0.8] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 9, column 7 or of the polypeptide as shown in the amino acid sequences as disclosed in table II, application no. 9, columns 5 and 7 or the functional homologues thereof as described herein, or is encoded by the nucleic acid molecule characterized herein or the nucleic acid molecule according to the invention, for example by the nucleic acid molecule as shown in table I, application no. 9, columns 5 and 7 or its herein described functional homologues and has the herein mentioned activity.

For the purposes of the present invention, the term "palmitic acid" also encompasses the corresponding salts, such as, for example, the potassium or sodium salts of palmitic acid or the salts of palmitic acid with amines such as diethylamine as well as triglycerides, lipids, oils and/or fats containing palmitic acid.

for the disclosure of the paragraphs [0065.0.0.8] and [0066.0.0.8] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 9, columns 5 and 7 or its homologs activity having herein-mentioned palmitic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 9, columns 5 and 7, e.g. a nucleic acid sequence encoding a polypeptide having the activity of a protein as indicated in table II, application no. 9, columns 5 and 7 or its homologs activity or of a mRNA encoding the polypeptide of the present invention having herein-mentioned palmitic acid increasing activity; and/or c) increasing the specific activity of a protein conferring the increased expression of a protein encoded by the nucleic acid molecule of the invention or of the polypeptide of the present invention having herein-mentioned palmitic acid increasing activity, e.g. of a polypeptide having the activity of a protein as indicated in table II, application no. 9, columns 5 and 7 or its homologs activity, or decreasing the inhibitiory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned palmitic acid increasing activity, e.g. of a polypeptide having the activity of a protein as indicated in table II, application no. 9, columns 5 and 7 or its homologs activity; and/or e) stimulating activity of a protein conferring the increased expression of a protein encoded by the nucleic acid molecule of the present invention or a polypeptide of the present invention having herein-mentioned palmitic acid increasing activity, e.g. of a polypeptide having the activity of a protein as indicated in table II, application no. 9, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned palmitic acid increasing activity, e.g. of a polypeptide having the activity of a protein as indicated in table II, application no. 9, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned palmitic acid increasing activity, e.g. of a polypeptide having the activity of a protein as indicated in table II, application no. 9, columns 5 and 7 or its homologs activity; and/or h) increasing the expression of the endogenous gene encoding the polypeptide of the invention, e.g. a polypeptide having the activity of a protein as indicated in table II, application no. 9, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned palmitic acid increasing activity, e.g. of polypeptide having the activity of a protein as indicated in table II, application no. 9, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned palmitic acid increasing activity, e.g. of a polypeptide having the activity of a protein as indicated in table II, application no. 9, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned palmitic acid increasing activity, e.g. of a polypeptide having the activity of a protein as indicated in table II, application no. 9, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 9, column 3 or its homologs. Preferably the increase of the fine chemical takes place in plastids.

for the disclosure of the paragraphs [0069.0.0.8] to [0079.0.0.8] see paragraphs [0069.0.0.0] to [0079.0.0.0] above.

The activation of an endogenous polypeptide having above-mentioned activity, e.g. having the activity of a protein as shown in table II, application no. 9, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 9, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 9, column 3. The expression of the chimeric transcription factor in a organism, in particular in a plant, leads to a specific expression of the protein as shown in table II, application no. 9, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.8] to [0084.0.0.8] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous fatty acid composition comprising a higher content of (from a viewpoint of nutritional physiology limited) fatty acids, like palmitate and/or palmitoleate.

for the disclosure of this paragraph see paragraph [0086.0.0.0] above.

By influencing the metabolism thus, it is possible to produce, in the process according to the invention, further advantageous compounds. Examples of such compounds are, in addition to palmitic acid, triglycerides, lipids, oils and/or fats containing palmitic acid compounds such as palmitate and/or palmitoleate.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 9, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound fatty acids, in particular palmitic acid, palmitate, palmitoleic acid and/or palmitoleate.

for the disclosure of the paragraphs [0090.0.0.8] to [0097.0.0.8] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 9, columns 5 and 7 or a derivative thereof, or b) a genetic regulatory element, for example a promoter, which is functionally linked to the nucleic acid sequence as shown table I, application no. 9, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 9, columns 5 and 7 joined to a nucleic acid sequence encoding a transit peptide, or a targeting nucleic acid sequence which directs the nucleic acid sequences disclosed in table I, application no. 9, columns 5 and 7 to the organelle preferentially the plastids. Altenatively the inventive nucleic acids sequences consist advantageously of the nucleic acid sequences as depicted in the sequence protocol and disclosed in table I, application no. 9, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose fatty acid content is modified advantageously owing to the nucleic acid molecule of the present invention expressed. This is important for plant breeders since, for example, the nutritional value of plants for poultry is dependent on the abovementioned essential fatty acids and the general amount of fatty acids as energy source in feed. After the activity of the protein as shown in table II, application no. 9, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.8] to [0110.0.0.8] see paragraphs [0102.0.0.0] to [0110.0.0.0] above.

In a preferred embodiment, the fine chemical (palmitic acid) is produced in accordance with the invention and, if desired, is isolated. The production of further fatty acids such as palmitoleic acid and/or mixtures thereof or mixtures of other fatty acids by the process according to the invention is advantageous. It may be advantageous to increase the pool of free fatty acids in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example a fatty acid transporter protein or a compound, which functions as a sink for the desired fatty acid for example for palmitic acid in the organism is useful to increase the production of the respective fine chemical (see Bao and Ohirogge, Plant Physiol. 1999 August; 120 (4): 1057-1062). Such fatty acid transporter protein may serve as a link between the location of fatty acid synthesis and the socalled sink tissue, in which fatty acids, triglycerides, oils and fats are stored.

for the disclosure of the paragraphs [0113.0.5.8] to [0115.0.5.8] see paragraphs [0113.0.5.5] to [0115.0.5.5] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 9, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 9, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybidizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 9, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 9, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 9, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;
or which comprises a sequence which is complementary thereto.

In one embodiment, the nucleic acid molecule used in the process of the invention distinguishes over the sequence indicated in table IA, application no. 9, columns 5 and 7 by one or more nucleotides. In one embodiment, the nucleic acid molecule used in the process of the invention does not consist of the sequence indicated in table IA, application no. 9, columns 5 and 7. In one embodiment, the nucleic acid molecule used in the process of the invention is less than 100%, 99.999%, 99.99%, 99.9% or 99% identical to a sequence indicated in table IA, application no. 9, columns 5 and 7. In another embodiment, the nucleic acid molecule does not encode a polypeptide of a sequence indicated in table IIA, application no. 9, columns 5 and 7.

In one embodiment, the nucleic acid molecule used in the process of the invention distinguishes over the sequence indicated in table IB, application no. 9, columns 5 and 7, by one or more nucleotides. In one embodiment, the nucleic acid molecule used in the process of the invention does not consist of the sequence indicated in table IB, application no. 9, columns 5 and 7. In one embodiment, the nucleic acid molecule used in the process of the invention is less than 100%, 99.999%, 99.99%, 99.9% or 99% identical to a sequence indicated in table IB, application no. 9, columns 5 and 7. In another embodiment, the nucleic acid molecule does not encode a polypeptide of a sequence indicated in table IIB, application no. 9, columns 5 and 7.

In one embodiment, the nucleic acid molecule used in the process distinguishes over the sequence shown in table I, application no. 9, columns 5 and 7 by one or more nucleotides or does not consist of the sequence shown in table I, application no. 9, columns 5 and 7. In one embodiment, the nucleic acid molecule of the present invention is less than 100%, 99.999%, 99.99%, 99.9% or 99% identical to the sequence shown in table I, application no. 9, columns 5 and 7. In another embodiment, the nucleic acid molecule does not encode a polypeptide of the sequence shown in table II, application no. 9, columns 5 and 7.

for the disclosure of the paragraphs [0118.0.0.8] to [0120.0.0.8] see paragraphs [0118.0.0.0] to [0120.0.0.0] above.

Nucleic acid molecules with the sequence shown in table I, application no. 9, columns 5 and 7, nucleic acid molecules which are derived from the amino acid sequences shown in table II, application no. 9, columns 5 and 7 or from polypeptides comprising the consensus sequence shown in table IV, application no. 9, column 7, or their derivatives or homologues encoding polypeptides with the enzymatic or biological activity of a protein as shown in table II, application no. 9, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 9, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 9, column 3 and conferring the fine chemical increase by expression either in the cytsol or in an organelle such as a plastid or mitochondria or both, preferably in plastids.

for the disclosure of the paragraphs [0126.0.0.8] to [0133.0.0.8] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 9, columns 5 and 7 or the functional homologues thereof as described herein, preferably conferring above-mentioned activity, i.e. conferring the fine chemical increase after increasing its activity, e.g. after increasing the activity of a protein as shown in table II, application no. 9, column 3 by for example expression either in the cytsol or in an organelle such as a plastid or mitochondria or both, preferably in plastids.

for the disclosure of the paragraphs [0135.0.0.8] to [0140.0.0.8] see paragraphs [0135.0.0.0] to [0140.0.0.0] above.

Synthetic oligonucleotide primers for the amplification, e.g. as shown in table III, application no. 9, column 7, by means of polymerase chain reaction can be generated on the basis of a sequence shown herein, for example the sequence shown in table I, application no. 9, columns 5 and 7 or the sequences derived from table II, application no. 9, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 9, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 9, column 3 or further functional homologs of the polypeptide of the invention from other organisms.

for the disclosure of the paragraphs [0144.0.0.8] to [0151.0.0.8] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 9, columns 5 and 7, preferably of table IB, application no. 9, columns 5 and 7 under relaxed hybridization conditions and which code on expression for peptides having the palmitic acid, triglycerides, lipids, oils and/or fats containing palmitic acid increasing activity.

for the disclosure of the paragraphs [0153.0.0.8] to [0159.0.0.8] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 9, columns 5 and 7, preferably shown in table IB, application no. 9, columns 5 and 7 is one which is sufficiently complementary to one of the nucleotide sequences shown in table I, application no. 9, columns 5 and 7, preferably shown in table IB, application no. 9, columns 5 and 7 such that it can hybridize to one of the nucleotide sequences shown in table I, application no. 9, columns 5 and 7, preferably shown in table IB, application no. 9, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 9, columns 5 and 7, preferably shown in table IB, application no. 9, columns 5 and 7, or a portion thereof and preferably has above mentioned activity, in particular having a fine chemical increasing activity after increasing the activity or an activity of a gene product as shown in table II, application no. 9, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 9, columns 5 and 7, preferably shown in table IB, application no. 9, columns 5 and 7, or a portion thereof and encodes a protein having above-mentioned activity, e.g. conferring of a palmitic acid, triglycerides, lipids, oils and/or fats containing palmitic acid increase by for example expression either in the cytsol or in an organelle such as a plastid or mitochondria or both, preferably in plastids, and optionally, the activity of a protein as shown in table II, application no. 9, column 3.

Moreover, the nucleic acid molecule of the invention can comprise only a portion of the coding region of one of the sequences shown in table I, application no. 9, columns 5 and 7, preferably shown in table IB, application no. 9, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 9, columns 5 and 7, an anti-sense sequence of one of the sequences, e.g., set forth in table I, application no. 9, columns 5 and 7, preferably shown in table IB, application no. 9, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 9, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 9, columns 5 and 7 such that the protein or portion thereof maintains the ability to participate in the fine chemical production, in particular a palmitic acid, triglycerides, lipids, oils and/or fats containing palmitic acid increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 9, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 9, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.8] and [0169.0.0.8] see paragraphs [0168.0.0.0] and [0169.0.0.0] above.

The invention further relates to nucleic acid molecules that differ from one of the nucleotide sequences shown in table I, application no. 9, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 9, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 9, columns 5 and 7 or the functional homologues. In a still further embodiment, the nucleic acid molecule of the invention encodes a full length protein which is substantially homologous to an amino acid sequence shown in table II, application no. 9, columns 5 and 7 or the functional homologues. However, in a preferred embodiment, the nucleic acid molecule of the present invention does not consist of the sequence shown in table I, application no. 9, columns 5 and 7, preferably as indicated in table IA, application no. 9, columns 5 and 7. Preferably the nucleic acid molecule of the invention is a functional homologue or identical to a nucleic acid molecule indicated in table IB, application no. 9, columns 5 and 7.

for the disclosure of the paragraphs [0171.0.0.8] to [0173.0.0.8] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 9, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 9, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 9, columns 5 and 7.

for the disclosure of the paragraphs [0179.0.0.8] and [0180.0.0.8] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 9, columns 5 and 7, preferably shown in table IIA, application no. 9, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 9, columns 5 and 7, preferably shown in table IIA, application no. 9, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 9, columns 5 and 7, preferably shown in table IIA, application no. 9, columns 5 and 7, more preferably at least about 70% identical to one of the sequences shown in table II, application no. 9, columns 5 and 7, preferably shown in table IIA, application no. 9, columns 5 and 7, even more preferably at least about 80%, 90%, 95% homologous to the sequence shown in table II, application no. 9, columns 5 and 7, preferably shown in table IIA, application no. 9, columns 5 and 7, and most preferably at least about 96%, 97%, 98%, or 99% identical to the sequence shown in table II, application no. 9, columns 5 and 7, preferably shown in table IIA, application no. 9, columns 5 and 7.

for the disclosure of the paragraphs [0182.0.0.8] to [0188.0.0.8] see paragraphs [0182.0.0.0] to [0188.0.0.0] above.

Functional equivalents derived from one of the polypeptides as shown in table II, application no. 9, columns 5 and 7, preferably shown in table IIB, application no. 9, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 9, columns 5 and 7, preferably shown in table IIB, application no. 9, columns 5 and 7 resp., according to the invention and are distinguished by essentially the same properties as the polypeptide as shown in table II, application no. 9, columns 5 and 7, preferably shown in table IIB, application no. 9, columns 5 and 7.

Functional equivalents derived from the nucleic acid sequence as shown in table I, application no. 9, columns 5 and 7, preferably shown in table IB, application no. 9, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 9, columns 5 and 7, preferably shown in table IIB, application no. 9, columns 5 and 7 resp., according to the invention and encode polypeptides having essentially the same properties as the polypeptide as shown in table II, application no. 9, columns 5 and 7, preferably shown in table IIB, application no. 9, columns 5 and 7.

for the disclosure of this paragraph see paragraph [0191.0.0.0] above.

A nucleic acid molecule encoding an homologous to a protein sequence of table II, application no. 9, columns 5 and 7, preferably shown in table IIB, application no. 9, columns 5 and 7 resp., can be created by introducing one or more nucleotide substitutions, additions or deletions into a nucleotide sequence of the nucleic acid molecule of the present invention, in particular of table I, application no. 9, columns 5 and 7, preferably shown in table IB, application no. 9, columns 5 and 7 resp., such that one or more amino acid substitutions, additions or deletions are introduced into the encoded protein. Mutations can be introduced into the encoding sequences of table I, application no. 9, columns 5 and 7, preferably shown in table IB, application no. 9, columns 5 and 7 resp., by standard techniques, such as site-directed mutagenesis and PCR-mediated mutagenesis.

for the disclosure of the paragraphs [0193.0.0.8] to [0196.0.0.8] see paragraphs [0193.0.0.0] to [0196.0.0.0] above.

Homologues of the nucleic acid sequences used, with the sequence shown in table I, application no. 9, columns 5 and 7, preferably shown in table IB, application no. 9, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 9, columns 5 and 7, preferably shown in table IB, application no. 9, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 9, columns 5 and 7, preferably shown in table IB, application no. 9, columns 5 and 7. It is preferred that the nucleic acid molecule comprises as little as possible other nucleotides not shown in any one of table I, application no. 9, columns 5 and 7, preferably shown in table IB, application no. 9, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 9, columns 5 and 7, preferably shown in table IB, application no. 9, columns 5 and 7.

Also preferred is that the nucleic acid molecule used in the process of the invention encodes a polypeptide comprising the sequence shown in table II, application no. 9, columns 5 and 7, preferably shown in table IIB, application no. 9, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 9, columns 5 and 7, preferably shown in table IIB, application no. 9, columns 5 and 7.

In one embodiment, the nucleic acid molecule of the invention or used in the process encodes a polypeptide comprising the sequence shown in table II, application no. 9, columns 5 and 7, preferably shown in table IIB, application no. 9, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 9, columns 5 and 7, preferably shown in table IB, application no. 9, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 9, columns 5 and 7 expressed under identical conditions.

Homologues of table I, application no. 9, columns 5 and 7 or of the derived sequences of table II, application no. 9, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.8] to [0215.0.0.8] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 9, columns 5 and 7, preferably in table II B, application no. 9, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 9, columns 5 and 7, preferably in table IB, application no. 9, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 9, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 9, column 7 and conferring an increase in the amount of the fine chemical in an organism or a part thereof;

k) nucleic acid molecule encoding the amino acid sequence of a polypeptide encoding a domain of the polypeptide shown in table II, application no. 9, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 9, columns 5 and 7 or a nucleic acid molecule encoding, preferably at least the mature form of, the polypeptide shown in table II, application no. 9, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 9, columns 5 and 7 by one or more nucleotides. In one embodiment, the nucleic acid molecule of the invention does not consist of the sequence shown in table IA and/or IB, application no. 9, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 9, columns 5 and 7. In a further embodiment the nucleic acid molecule does not encode the polypeptide sequence shown in table IIA and/or IIB, application no. 9, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 9, columns 5 and 7 does not encode a protein of the sequence shown in table IIA and/or IIB, application no. 9, columns 5 and 7. Accordingly, in one embodiment, the protein encoded by a sequence of a nucleic acid according to (a) to (l) does not consist of the sequence shown in table IA and/or IB, application no. 9, columns 5 and 7. In a further embodiment, the protein of the present invention is at least 30% identical to protein sequence depicted in table IIA and/or IIB, application no. 9, columns 5 and 7 and less than 100%, preferably less than 99.999%, 99.99% or 99.9%, more preferably less than 99%, 985, 97%, 96% or 95% identical to the sequence shown in table IIA and/or IIB, application no. 9, columns 5 and 7.

for the disclosure of the paragraphs [0217.0.0.8] to [0226.0.0.8] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 9, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.8] to [0239.0.0.8] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 9, columns 5 and 7 or its derivatives, it is advantageous additionally to express and/or mutate further genes in the organisms. Especially advantageously, additionally at least one further gene of the fatty acid biosynthetic pathway such as for palmitate, palmitoleate, stearate and/or oleate is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 9, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.5.8] and [0242.0.5.8] see paragraphs [0241.0.5.5] and [0242.0.5.5] above.

In a further advantageous embodiment of the process of the invention, the organisms used in the process are those in which simultaneously a palmitic acid degrading protein is attenuated, in particular by reducing the rate of expression of the corresponding gene.

for the disclosure of this paragraph see paragraph [0242.2.5.5] above.

for the disclosure of the paragraphs [0243.0.0.8] to [0264.0.0.8] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 9, columns 5 and 7 and described herein to achieve an expression in one of said compartments or extracellular.

for the disclosure of the paragraphs [0266.0.0.8] to [0287.0.0.8] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 9, columns 5 and 7 or their homologs is functionally linked to a plastidial targeting sequence. A further preferred embodiment of the invention relates to a vector in which a nucleic acid sequence encoding one of the polypeptides shown in table II, application no. 9, columns 5 and 7 or their homologs is functionally linked to a regulatory sequences which permit the expression in plastids.

for the disclosure of the paragraphs [0289.0.0.8] to [0296.0.0.8] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0403, anti-b0488, anti-b1410, anti-b1627, anti-b1758, anti-b1980, anti-b2066, anti-b2223, anti-b1095, ant-YPR035W and/or anti-YLR099C protein antibody or an antibody against polypeptides as shown in table II, application no. 9, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 9, columns 5 and 7 or as coded by the nucleic acid molecule shown in table I, application no. 9, columns 5 and 7 or functional homologues thereof.

In one advantageous embodiment, in the method of the present invention the activity of a polypeptide is increased comprising or consisting of the consensus sequence shown in table IV, application no. 9, columns 7 and in one another embodiment, the present invention relates to a polypeptide comprising or consisting of the consensus sequence shown in table IV, application no. 9, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.8] to [0304.0.0.8] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 9, columns 5 and 7 by one or more amino acids. In one embodiment, polypeptide distinguishes form the sequence shown in table IIA and/or IIB, application no. 9, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 9, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 9, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 9, columns 5 and 7 by one or more amino acids. In another embodiment, said polypeptide of the invention does not consist of the sequence shown in table IIA and/or IIB, application no. 9, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 9, columns 5 and 7.

In one embodiment, the present invention relates to a polypeptide having the activity of the protein as shown in table IIA and/or IIB, application no. 9, column 3, which distinguishes over the sequence depicted in table IIA and/or IIB, application no. 9, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.8] to [0311.0.0.8] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 9, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 9, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 9, columns 5 and 7 or which is homologous thereto, as defined above.

Accordingly the polypeptide of the present invention can vary from the sequences shown in table IIA and/or IIB, application no. 9, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 9, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 9, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 9, column 3. Differences shall mean at least one amino acid different from the sequences as shown in table II, application no. 9, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 9, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 9, column 3. The nucleic acid molecules and polypeptide molecules of the invention are expressed such that the yield, production, and/or efficiency of production of a desired compound is improved.

for the disclosure of the paragraphs [0320.0.0.8] to [0322.0.0.8] see paragraphs [0320.0.0.0] to [0322.0.0.0] above.

In one embodiment, a protein (=polypeptide) as shown in table II, application no. 9, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 9, column 3, e.g., a protein which does not confer the activity described herein and which is derived from the same or a different organism.

for the disclosure of the paragraphs [0324.0.0.8] to [0329.0.0.8] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 9, columns 5 and 7.

for the disclosure of the paragraphs [0331.0.0.8] to [0346.0.0.8] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 9, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 9, column 3 or a protein as shown in table II, application no. 9, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 9, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.8] to [0358.0.0.8] see paragraphs [0350.0.0.0] to [0358.0.0.0] above.

for the disclosure of the paragraph [0359.0.5.8] see paragraph [0359.0.5.5] above.

for the disclosure of the paragraphs [0360.0.0.8] to [0362.0.0.8] see paragraphs [0360.0.0.0] to [0362.0.0.0] above.

for the disclosure of the paragraphs [0363.0.5.8] to [0365.0.5.8] see paragraphs [0363.0.5.5] to [0365.0.5.5] above.

for the disclosure of the paragraphs [0366.0.0.8] to [0369.0.0.8] see paragraphs [0366.0.0.0] to [0369.0.0.0] above.

The fermentation broths obtained in this way, containing in particular palmitic acid, triglycerides, lipids, oils and/or fats containing palmitic acid, normally have a dry matter content of from 7.5 to 25% by weight. The fermentation broth can be processed further. Depending on requirements, the biomass can be seperated, such as, for example, by centrifugation, filtration, decantation or a combination of these methods, from the fermentation broth or left completely in it. Afterwards the biomass can be extracted without any further process steps or disrupted and then extracted. If necessary the fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction.

for the disclosure of this paragraph see paragraph [0371.0.5.5] above.

for the disclosure of the paragraphs [0372.0.0.8] to [0376.0.0.8], [0376.1.0.8] and [0377.0.0.8] see paragraphs [0372.0.0.0] to [0376.0.0.0], [0376.1.0.0] and [0377.0.0.0] above.

for the disclosure of the paragraph [0376.1.0.8] see paragraph [0376.1.0.0] above.

for the disclosure of the paragraph [0377.0.0.8] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting, e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 9, columns 5 and 7, preferably in table IB, application no. 9, columns 5 and 7, and, optionally, isolating the full length cDNA clone or complete genomic clone;

(c) introducing the candidate nucleic acid molecules in host cells, preferably in a plant cell or a microorganism, appropriate for producing the fine chemical;

(d) expressing the identified nucleic acid molecules in the host cells;

(e) assaying the fine chemical level in the host cells; and (f) identifying the nucleic acid molecule and its gene product which expression confers an increase in the fine chemical level in the host cell after expression compared to the wild type.

for the disclosure of the paragraphs [0379.0.0.8] to [0383.0.0.8] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 9, column 3, e.g. comparing near identical organisms with low and high activity of the proteins as shown in table II, application no. 9, column 3.

for the disclosure of the paragraphs [0385.0.0.8] to [0404.0.0.8] see paragraphs [0385.0.0.0] to [0404.0.0.0] above.

for the disclosure of this paragraph see paragraph [0405.0.5.5] above.

for the disclosure of the paragraphs [0406.0.0.8] to [0435.0.0.8] see paragraphs [0406.0.0.0] to [0435.0.0.0] above.

Palmitic acid or triglycerides, lipids, oils and/or fats containing palmitic acid production in *Mortierella*

The fatty acid production can be analysed as mentioned above. The proteins and nucleic acids can be analysed as mentioned below.

for the disclosure of the paragraphs [0437.0.0.8] and [0438.0.0.8] see paragraphs [0437.0.0.0] and [0438.0.0.0] above.

for the disclosure of the paragraphs [0439.0.5.8] and [0440.0.5.8] see paragraphs [0439.0.5.5] and [0440.0.5.5] above.

for the disclosure of this paragraph see [0441.0.0.0] above.

for the disclosure of the paragraphs ([0442.0.5.8] and [0445.0.5.8] see paragraphs [0442.0.5.5] and [0445.0.5.5] above.

for the disclosure of the paragraphs [0446.0.0.8] to [0497.0.0.8] see paragraphs [0446.0.0.0] to [0497.0.0.0] above.

The results of the different plant analyses can be seen from the table, which follows:

TABLE VI

| ORF | Metabolite | Method/ Analytics | Min.- Value | Max.- Value |
|---|---|---|---|---|
| b0403 | Palmitic acid (C16:0) | GC | 1.21 | 1.40 |
| b0488 | Palmitic acid (C16:0) | GC | 1.16 | 1.43 |
| b1095 | Palmitic acid (C16:0) | GC | 1.16 | 1.47 |
| b1410 | Palmitic acid (C16:0) | GC | 1.28 | 1.41 |
| b1627 | Palmitic acid (C16:0) | GC | 1.16 | 1.24 |
| b1758 | Palmitic acid (C16:0) | GC | 1.16 | 1.29 |
| b1980 | Palmitic acid (C16:0) | GC | 1.16 | 1.33 |
| b2066 | Palmitic acid (C16:0) | GC | 1.19 | 1.46 |
| b2223 | Palmitic acid (C16:0) | GC | 1.17 | 1.89 |
| YLR099C | Palmitic acid (C16:0) | GC | 1.15 | 1.50 |
| YPR035W | Palmitic acid (C16:0) | GC | 1.25 | 1.60 | for the disclosure of the paragraphs [0499.0.0.8] and [0500.0.0.8] see paragraphs [0499.0.0.0] and [0500.0.0.0] above.

Example 15a

Engineering Ryegrass Plants by Over-Expressing YLR099C or YPR035W from *Saccharomyces cerevisiae* or Homologs of YLR099C or YPR035W from Other Organisms for the disclosure of the paragraphs [0502.0.0.8] to [0508.0.0.8] see paragraphs [0502.0.0.0] to [0508.0.0.0] above.

Example 15b

Engineering Soybean Plants by Over-Expressing YLR099C or YPR035W from *Saccharomyces cerevisiae* or Homologs of YLR099C or YPR035W from Other Organisms for the disclosure of the paragraphs [0510.0.0.8] to [0513.0.0.8] see paragraphs [0510.0.0.0] to [0513.0.0.0] above.

Example 15c

Engineering Corn Plants by Over-expressing YLR099C or YPR035W from *Saccharomyces cerevisiae* or Homologs of YLR099C or YPR035W from Other Organisms for the disclosure of the paragraphs [0515.0.0.8] to [0540.0.0.8] see paragraphs [0515.0.0.0] to [0540.0.0.0] above.

Example 15d

Engineering Wheat Plants by Over-Expressing YLR099C or YPR035W from *Saccharomyces cerevisiae* or Homologs of YLR099C or YPR035W from Other Organisms for the disclosure of the paragraphs [0542.0.0.8] to [0544.0.0.8] see paragraphs [0542.0.0.0] to [0544.0.0.0] above.

Example 15e

Engineering Rapeseed/Canola Plants by Over-Expressing YLR099C or YPR035W from *Saccharomyces cerevisiae* or Homologs of YLR099C or YPR035W from Other Organisms for the disclosure of the paragraphs [0546.0.0.8] to [0549.0.0.8] see paragraphs [0544.0.0.0] to [0549.0.0.0] above.

Example 15f

Engineering Alfalfa Plants by Over-Expressing YLR099C or YPR035W from *Saccharomyces cerevisiae* or Homologs of YLR099C or YPR035W from Other Organisms for the disclosure of the paragraphs [0551.0.0.8] to [0554.0.0.8] see paragraphs [0551.0.0.0] to [0554.0.0.0] above.

%
for the disclosure of this paragraph see [0554.2.0.0] above.
for the disclosure of this paragraph see [0555.0.0.0] above.
for the disclosure of this paragraph see [0001.0.0.0].

Due to their plastids, plants possess some biosynthetic pathways, which are, besides in cyanobacteria, unique in living organisms. Some plastidic compounds are indispensable for human and animal nutrition and are therefore called vitamins. Two essential lipophilic components for nutrition are provitamin A (betacarotene) and vitamin E.

Vitamin E is classified by its pharmacological effect and chromanol ring structure and not by biosynthesis. It comprises a class of 8 lipid-soluble components, being subdivided into tocopherols and tocotrienols. While tocopherols share an isoprenoid side chain derived from phytyl-PP, tocotrienol side chains are derivates of geranylgerany-PP. The α, β, γ and δ-members of these subclasses differ in their degree of methylation in the 6-chromanol-ring structure.

The tocopherol group (1a-d) has a saturated side chain, and the tocotrienol group (2a-d) has an unsaturated side chain:

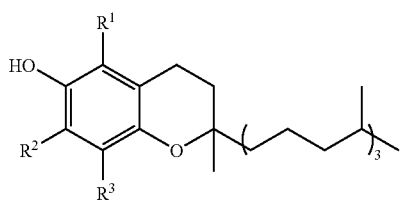

(1)

1a, α-tocopherol: $R^1 = R^2 = R^3 = CH_3$
1b, β-tocopherol: $R^1 = R^3 = CH_3, R^2 = H$
1c, γ-tocopherol: $R^1 = H, R^2 = R^3 = CH_3$
1d, δ-tocopherol: $R^1 = R^2 = H, R^3 = CH_3$

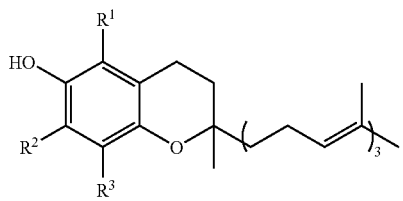

(2)

2a, α-tocotrienol: $R^1 = R^2 = R^3 = CH_3$
2b, β-tocotrienol: $R^1 = R^3 = CH_3, R^2 = H$
2c, γ-tocotrienol: $R^1 = H, R^2 = R^3 = CH_3$
2d, δ-tocotrienol: $R^1 = R^2 = H, R^3 = CH_3$ In the present invention, vitamin E means all of the aforementioned tocopherols and tocotrienols with vitamin E activity.

The four major forms of tocopherols, α, β, γ, and δ, differ in the position and number of methyl groups. The predominant form in the leaves of higher plants is α-tocopherol, whereas in seeds γ-tocopherol is often the major isoform. Tocopherols predominantly function as antioxidants in vivo in photosynthetic organisms and in animals, as well as in isolated compounds such as oils. The antioxidant properties of tocopherols derive from their ability to quench free radicals and different tocopherols may be optimal as antioxidants for different biological systems. For human and animal utility, α-tocopherol has the highest vitamin E activity and has been implicated in a variety of health areas, including possible benefits in preventing cardiovascular disease, certain cancers, and cataract formation. The amounts of vitamin E needed to achieve these effects are often quite high, 100 to 400 International Units (I.U.) and even up to 800 I.U. compared with the recommended daily allowance of 40 I.U. In fats and oils, tocopherols protect unsaturated fatty acids from oxidation. In these systems, γ-tocopherol appears to have the greater utility. In fact, tocopherols are often included in processed oils to help stabilize the fatty acids. For human health as well as food and feed utility, it is desirable to have plants with increased tocopherol content along with those where the tocopherol composition is customized.

Tocopherols contain an aromatic head group, which is derived from homogentisic acid (HGA) and a hydrocarbon portion, which arises from phytyldiphosphate (phytyl-DP). HGA is derived from the shikimic acid pathway and phytyl-DP is generated from the condensation of four isoprenoid units. The isoprenoid contribution to tocopherol biosynthesis is thought to come primarily from the plastidal methylerythritol phosphate pathway, and not the cytosolic mevalonic acid pathway. The condensation of HGA and phytyl-DP to form 2-methyl-6-phytylplastoquinol, the first committed step in tocopherol biosynthesis, is a prenyltransferase reaction that is performed by a homogentisate phytyltransferase (HPT). Subsequent cyclization and methylation reactions result in the formation of the four major tocopherols. The enzymatic reactions in tocopherol biosynthesis were identified 15 to 20 years ago, but cloning of the genes encoding these enzymes has only occurred in the last few years.

Tocopherol biosynthesis takes place in the plastid and the enzymes are associated with the chloroplast envelope. The membrane association of the enzymes has made purification difficult. With the advent of genomics and the availability of complete genome sequences of a number of organisms, including Synechocystis sp. PCC 6803 and Arabidopsis, it has become possible to use bioinformatics techniques to identify and clone additional genes in the tocopherol pathway.

The first enzyme cloned in the tocopherol pathway, γ-tocopherol methyl transferase (γ-TMT), was identified in Synechocystis sp. PCC 6803 and Arabidopsis using bioinformatics. In that study, the Arabidopsis γ-TMT was shown to alter seed tocopherol composition when overexpressed in Arabidopsis. γ-Tocopherol, normally the predominant tocopherol isomer in Arabidopsis seeds, was almost completely converted to γ-tocopherol.

HPT catalyzes the first committed reaction in the tocopherol pathway, and was unidentified previously. Concomitant with this study, slr1736 was found to encode a HPT in Synechocystis sp. PCC 6803 and the Arabidopsis HTP was identified.

There are prenyltransferases that condense prenyl groups with allylic chains and those that condense prenyl chains with aromatic groups. The prenyltransferases that catalyze sequential condensations of isopentenylpyrophosphate with allylic chains share common features, including Asp-rich motifs, and lead to the formation of compounds with two isoprenoid units, such as geranylpyrophosphate, or to much longer molecules, such as rubber, which contains greater than 1,000 isoprenoid units. Prenyltransferases that catalyze condensations with nonisoprenoid groups have an Asp-rich motif distinct from that of the allylic class, and include UbiA, which attaches a prenyl group to 4-hydroxybenzoic acid, and chlorophyll synthase, which attaches a prenyl group to chlorophyllide.

The first committed step in tocopherol biosynthesis is catalyzed by an aromatic prenyltransferase that transfers a phytyl chain to HGA Classification by head groups would arrange tocopherols, tocotrienols and plastoquinones in one group, being quinones with antioxidant properties and having homogentisic acid as a precursor. Plastoquinones are important components of the quinone-pool in the photosynthetic electron transport chains of plastids, also interfering in the biosynthesis of provitamin A (beta-carotene; Norris S R, (1995). *Plant Cell* 7, 2139-2149).

Vitamin E is predominantly delivered by the ingestion of vegetable oils. It plays an important role as a membrane-associated antioxidant scavenger. During past years several additional functions of vitamin E as anti-hypercholesterolemic and immunostimulatory agent in humans have been proposed (Beharka (1997). *Methods Enzymol.* 282, 247-263).

These compounds with vitamin E activity are important natural fat-soluble antioxidants. A vitamin E deficiency leads to pathophysiological situations in humans and animals. Vitamin E compounds therefore are of high economical value as additives in the food and feed sectors, in pharmaceutical formulations and in cosmetic applications.

In plastids of plants many isoprenoid pathways are localized, which are interconnected by their substrates, end products and by regulation. These are, e.g. monoterpene-, diterpene-, giberillic acid-, abscisic acid-, chlorophyll-, phylloquinone-, carotenoid-, tocopherol-, tocotrienol- and plastoquinone-biosynthesis. In all these pathways prenyltransferases are involved in the biosynthesis of these compounds. With respect to the length of their side chains diterpenes, chlorophylls, phylloquinones, tocopherols and tocotrienols can be arranged into a $C_{20}$-group of isoprenoids. Another classification by degree of desaturation of the side chain, would arrange e.g. chlorophylls, phylloquinones and tocopherols into a phytyl-group and e.g. diterpenes, tocotrienols, plastoquinones and carotenoids into a group of desaturated isoprenoid compounds.

An economical method for producing vitamin E or its precursor and food- and feedstuffs with increased vitamin E content is therefore very important. Particularly economical methods are biotechnological methods utilizing vitamin E-producing organisms which are either natural or optimized by genetic modification.

There is a constant need for providing novel enzyme activities or direct or indirect regulators and thus alternative methods with advantageous properties for producing vitamin E or its precursor in organisms, e.g. in transgenic organisms.

Attempts are known to achieve an increase in the flow of metabolites so as to increase the tocopherol and/or tocotrienol content by overexpressing Phytyl/prenyltransferasegenes in transgenic organisms; WO 00/63391, WO 00/68393, WO 01/62781 and WO 02/33060.

Therefore improving the quality of foodstuffs and animal feeds is an important task of the food-and-feed industry. This is necessary since, for example, Vitamin E, which occur in plants and some microorganisms are limited with regard to the supply of mammals. Especially advantageous for the quality of foodstuffs and animal feeds is as balanced as possible a vitamin profile in the diet since a great excess of some vitamins above a specific concentration in the food has only some or little or no positive effect. A further increase in quality is only possible via addition of further vitamins, which are limiting.

To ensure a high quality of foods and animal feeds, it is therefore necessary to add one or a plurality of vitamins in a balanced manner to suit the organism.

Accordingly, there is still a great demand for new and more suitable genes which encode proteins which participate in the biosynthesis of vitamins, in particular vitamin E and make it possible to produce certain vitamins specifically on an industrial scale without unwanted byproducts forming. In the selection of genes for or regulators of biosynthesis two characteristics above all are particularly important. On the one hand, there is as ever a need for improved processes for obtaining the highest possible contents of vitamins like vitamin E on the other hand as less as possible by-products should be produced in the production process.

for the disclosure of this paragraph see [0013.0.0.0] above.

Accordingly, in a first embodiment, the invention relates to a process for the production of a fine chemical, whereby the fine chemical is vitamin E. Accordingly, in the present invention, the term "the fine chemical" as used herein relates to "vitamin E". Further, the term "the fine chemicals" as used herein also relates to fine chemicals comprising vitamin E.

In one embodiment, the term "Vitamin E" or "the fine chemical" or "the respective fine chemical" means at least one chemical compound with vitamin E activity selected from the group alpha-tocopherol, beta-tocopherol, gamma-tocopherol, delta-tocopherol, alpha-tocotrienol, beta-tocotrienol, gamma-tocotrienol and delta-tocotrienol. In another embodiment, the term "Vitamin E" or "the fine chemical" or "the respective fine chemical" means at least one chemical compound with vitamin E activity selected from the group alpha-tocopherol, beta-tocopherol, gamma-tocopherol, delta-tocopherol, alpha-tocotrienol, beta-tocotrienol, gamma-tocotrienol and delta-tocotrienol or the Vitamin E precourser 2,3-Dimethyl-5-phytylquinol. In a preferred embodiment, the term "the fine chemical" or the term "Vitamine E" or the term "the respective fine chemical" means at least one chemical compound with vitamin E activity selected from the group "alpha-tocopherol", "beta-tocopherol", "gamma-tocopherol", "alpha-tocotrienol", "beta-tocotrienol", and/or "gamma-tocotrienol".

An increased vitamin E content normally means an increased total vitamin E content. However, an increased vitamin E content also means, in particular, a modified content of the above-described 8 compounds with vitamin E activity, without the need for an inevitable increase in the total vitamin E content. In a preferred embodiment, the term "the fine chemical" means vitamin E in free form or its salts or its ester or bound.

Accordingly, the present invention relates to a process for the production of vitamin E, which comprises
(a) increasing or generating the activity of a protein as shown in table II, application no. 10, column 3 encoded by the nucleic acid sequences as shown in table I, application no. 10, column 5, in an organelle of a microorganism or plant, or
(b) increasing or generating the activity of a protein as shown in table II, application no. 10, column 3 encoded by the nucleic acid sequences as shown in table I, application no. 10, column 5 in the plastid of a microorganism or plant, or in one or more parts thereof; and
(c) growing the organism under conditions which permit the production of the fine chemical, thus, vitamin E or fine chemicals comprising vitamin E, in said organism or in the culture medium surrounding the organism.

Accordingly, the term "the fine chemical" means in one embodiment "2,3-dimethyl-5-pythylquinol" in relation to all sequences listed in Table I to IV, lines 92 to 97 or homologs thereof;

and means in one embodiment "alpha-tocopherol" in relation to all sequences listed in Tables I to IV, lines 85 to 90 or homologs thereof;

and means in one embodiment "alpha-tocotrienol" in relation to all sequences listed in Tables I to IV, line 91 or homologs thereof;

and means in one embodiment "beta-tocopherol" in relation to all sequences listed in Table I, lines 92 to 97, or homologs thereof;

and means in one embodiment "gamma-tocopherol" in relation to all sequences listed in Table I to IV, lines 92 to 97 or homologs thereof;

and means in one embodiment "beta-tocotrienol" in relation to all sequences listed in Table I, lines 98, or homologs thereof;

and means in one embodiment "gamma-tocotrienol" in relation to all sequences listed in Table I to IV, lines 98 or homologs thereof.

Accordingly, in one embodiment the term "the fine chemical" means "2,3-dimethyl-5phytylquinol", "beta-tocopherol" and "gamma-tocopherol" in relation to all sequences listed in Table I to IV, lines 92 to 97. In one embodiment the term "the fine chemical" means "beta-tocotrienol" and "gamma-tocotrienol" in relation to all sequences listed in Table I to IV, line 98.

Accordingly, the term "the fine chemical" can mean "2,3-dimethyl-5-pythylquinol", "alpha-tocopherol", "beta-tocopherol", "gamma-tocopherol", "alpha-tocotrienol", "betatocotrienol", and/or "gamma-tocotrienol", owing to circumstances and the context. In order to illustrate that the meaning of the term "the fine chemical" means "2,3-dimethyl5-pythylquinol", "alpha-tocopherol", "beta-tocopherol", "gamma-tocopherol", "alphatocotrienol", "beta-tocotrienol", and/or "gamma-tocotrienol" the term "the respective fine chemical" is also used.

In another embodiment the present invention is related to a process for the production of vitamin E, which comprises (a) increasing or generating the activity of a protein as shown in table II, application no. 6 column 3 encoded by the nucleic acid sequences as shown in table I, application no. 10, column 5, in an organelle of a non-human organism, or (b) increasing or generating the activity of a protein as shown in table II, application no. 10, column 3 encoded by the nucleic acid sequences as shown in table I, application no. 10, column 5, which are joined to a nucleic acid sequence encoding a transit peptide in a non-human organism, or in one or more parts thereof; or (c) increasing or generating the activity of a protein as shown in table II, application no. 10, column 3 encoded by the nucleic acid sequences as shown in table I, application no. 10, column 5, which are joined to a nucleic acid sequence encoding chloroplast localization sequence, in a non-human organism, or in one or more parts thereof, and (d) growing the organism under conditions which permit the production of vitamin E in said organism.

In another embodiment, the present invention relates to a process for the production of vitamin E, which comprises (a) increasing or generating the activity of a protein as shown in table II, application no. 10, column 3 encoded by the nucleic acid sequences as shown in table I, application no. 10, column 5, in an organelle of a microorganism or plant through the transformation of the organelle, or (b) increasing or generating the activity of a protein as shown in table II, application no. 10, column 3 encoded by the nucleic acid sequences as shown in table I, application no. 10, column 5 in the plastid of a microorganism or plant, or in one or more parts thereof through the transformation of the plastids; and (c) growing the organism under conditions which permit the production of the fine chemical, thus, vitamin E or fine chemicals comprising vitamin E, in said organism or in the culture medium surrounding the organism.

Advantageously the activity of the protein as shown in table II, application no. 10, column 3 encoded by the nucleic acid sequences as shown in table I, application no. 10, column 5 is increased or generated in the abovementioned process in the plastid of a microorganism or plant.

for the disclosure of the paragraphs [0019.0.0.9] to [0024.0.0.9] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 10, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-tranlationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 10, column 3 and its homologs as disclosed in table I, application no. 10, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 10, column 3 and its homologs as disclosed in table I, application no. 10, columns 5 and 7.

for the disclosure of the paragraphs [0027.0.0.9] to [0029.0.0.9] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 10, columns 5 and 7. The person skilled in the art is able to join said sequences in a functional manner. Advantageously the transit peptide part is cleaved off from the protein part shown in table II, application no. 10, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 10, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 10, columns 5 and 7. In case of the amino acid sequence QIA CSS the three amino acids in front of the start methionine are stemming from the LIC (=ligation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 10, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 10, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 10, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.9] and [0030.3.0.9] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 10, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table 1, application no. 10, columns 5 and 7 or a sequence encoding a protein, as depicted in table II, application no. 10, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table, 1, application no. 10, columns 5 and 7 or a sequence encoding a protein, as depicted in table II, application no. 10, columns 5 and 7 in such a manner that the viroid sequence transports a sequence transcribed from a sequence as depicted in table 1 application no. 10, columns 5 and 7 or a sequence encoding a protein as depicted in table II, application no. 10, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 10, columns 5 and 7 are encoded by different nucleic acids. Such a method is disclosed in WO 2004/

040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 10, columns 5 and 7.

In a preferred embodiment of the invention the nucleic acid sequences as shown in table I, application no. 10, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 10, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.9] and [0032.0.0.9] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 10, column 3. Preferably the modification of the activity of a protein as shown in table II, application no. 10, column 3 or their combination can be achieved by joining the protein to a transit peptide.

Surprisingly it was found, that the transgenic expression of the *E. coli* proteins shown in table II, application no. 10, column 3 in plastids of a plant such as *Arabidopsis thaliana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *E. coli* protein b1704, b2600, b2601, b2965, b3281, and/or b3390 in *Arabidopsis thaliana* conferred an increase in the 2,3-dimethyl-5-phytylquinol, which is a precursor in the biosynthesis of vitamin E, in particular of gamma-tocopherol and thus of alpha-tocopherol. Thus, an increase in the level of this precursor of the tocopherol biosynthesis can be advantageous for the production of vitamin E. For example, in one embodiment the level of 2,3-dimethyl-5-phytylquinol is increased in combination with the modulation of the expression of other genes of the biosynthesis of vitamin E, in particular of genes encoding enzymes metabolising 2,3-dimethyl-5-phytylquinol to produce vitamin E or a precursor thereof, such as the 2,3-dimethyl-5-phytylquinol-Cyclase and/or gamma-tocopherol-methyltransferase II.

for the disclosure of this paragraph see paragraph [0035.0.0.0] above.

The sequence of b1251 (Accession number F64872) from *Escherichia coli* has been published in Blattner et al., Science 277 (5331), 1453-1474 (1997), and its activity is being defined as "ycil protein". Accordingly, in one embodiment, the process of the present invention comprises the use of a "ycil protein" or its homolog, e.g. as shown herein, for the production of the fine chemical, meaning of vitamin E, in particular for increasing the amount of vitamin E in free or bound form in an organism or a part thereof, as mentioned. In one embodiment, in the process of the present invention the activity of a b1251 protein is increased or generated, e.g. from *Escherichia coli* or a homolog thereof, preferably linked at least to one transit peptide as mentioned for example in table V.

In another embodiment, in the process of the present invention the activity of a b1251 protein is increased or generated in a subcellular compartment of the organism or organism cell such as in an organelle like a plastid or mitochondria.

The sequence of b1704 (Accession number NP_416219) from *Escherichia coli* has been published in Blattner et al., Science 277 (5331), 1453-1474 (1997), and its activity is being defined as "3-deoxy-D-arabinoheptulosonate-7-phosphate synthase (DAHP synthetase), tryptophan-repressible". Accordingly, in one embodiment, the process of the present invention comprises the use of a "3-deoxy-D-arabinoheptulosonate-7-phosphate synthase (DAHP synthetase), tryptophan-repressible" or its homolog, e.g. as shown herein, for the production of the fine chemical, meaning of vitamin E, in particular for increasing the amount of vitamin E in free or bound form in an organism or a part thereof, as mentioned. In one embodiment, in the process of the present invention the activity of a b1704 protein is increased or generated, e.g. from *Escherichia coli* or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b2600 (Accession number NP_417091) from *Escherichia coli* has been published in Blattner et al., Science 277 (5331), 1453-1474 (1997), and its activity is being defined as "bifunctional chorismate mutase/prephenate dehydrogenase". Accordingly, in one embodiment, the process of the present invention comprises the use of a "bifunctional chorismate mutase/prephenate dehydrogenase" or its homolog, e.g. as shown herein, for the production of the fine chemical, meaning of vitamin E, in particular for increasing the amount of vitamin E in free or bound form in an organism or a part thereof, as mentioned. In one embodiment, in the process of the present invention the activity of a b2600 protein is increased or generated, e.g. from *Escherichia coli* or a homolog thereof, preferably linked at least to one transit peptide as mentioned for example in table V.

In another embodiment, in the process of the present invention the activity of a b2600 protein is increased or generated in a subcellular compartment of the organism or organism cell such as in an organelle like a plastid or mitochondria.

The sequence of b2601 (Accession number NP_417092) from *Escherichia coli* has been published in Blattner et al., Science 277 (5331), 1453-1474 (1997), and its activity is being defined as 3-deoxy-D-arabinoheptulosonate-7-phosphate (DAHP) synthase, tryptophan-repressible. Accordingly, in one embodiment, the process of the present invention comprises the use of a "3-deoxy-D-arabinoheptulosonate-7-phosphate (DAHP) synthase, trypothan-repressible" or its homolog, e.g. as shown herein, for the production of the fine chemical, meaning of vitamin E, in particular for increasing the amount of vitamin E in free or bound form in an organism or a part thereof, as mentioned. In one embodiment, in the process of the present invention the activity of a b2601 protein is increased or generated, e.g. from *Escherichia coli* or a homolog thereof, preferably linked at least to one transit peptide as mentioned for example in table V.

In another embodiment, in the process of the present invention the activity of a b2601 protein is increased or generated in a subcellular compartment of the organism or organism cell such as in an organelle like a plastid or mitochondria.

The sequence of b2965 (Accession number NP_417440) from *Escherichia coli* has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of vitamin E, in particular for increasing the amount of vitamin E in free or bound form in an organism or a part thereof, as mentioned. In one embodiment, in the process of the present invention the activity of a b2965 protein is increased or generated, e.g. from *Escherichia coli* or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b3281 (Accession number NP_417740) from *Escherichia coli* has been published in Blattner et al., Science 277 (5331), 1453-1474 (1997), and its activity is being defined as "Shikimate dehydrogenase". Accordingly, in one embodiment, the process of the present invention comprises the use of a "Shikimate dehydrogenase" or its homolog, e.g. as shown herein, for the production of the fine chemical, meaning of vitamin E, in particular for increasing the amount of vitamin E in free or bound form in an organism or a part thereof, as mentioned. In one embodiment, in the process of the present invention the activity of a b3281 protein is increased or generated, e.g. from *Escherichia coli* or a homolog thereof, preferably linked at least to one transit peptide as mentioned for example in table V.

In another embodiment, in the process of the present invention the activity of a b3281 protein is increased or generated in a subcellular compartment of the organism or organism cell such as in an organelle like a plastid or mitochondria.

The sequence of b3390 (Accession number YP_026215) from *Escherichia coli* has been published in Blattner et al., Science 277 (5331), 1453-1474 (1997), and its activity is being defined as "shikimate kinase I". Accordingly, in one embodiment, the process of the present invention comprises the use of a "shikimate kinase I" or its homolog, e.g. as shown herein, for the production of the fine chemical, meaning of vitamin E, in particular for increasing the amount of vitamin E in free or bound form in an organism or a part thereof, as mentioned. In one embodiment, in the process of the present invention the activity of a b3390 protein is increased or generated, e.g. from *Escherichia coli* or a homolog thereof, preferably linked at least to one transit peptide as mentioned for example in table V.

In another embodiment, in the process of the present invention the activity of a b3390 protein is increased or generated in a subcellular compartment of the organism or organism cell such as in an organelle like a plastid or mitochondria.

In one embodiment, the homolog of the b1251, b1704, b2600, b2601, b2965, b3281, and/or b3390 is a homolog having said activity and being derived from bacteria. In one embodiment, the homolog of the b1251, b1704, b2600, b2601, b2965, b3281, and/or b3390 is a homolog having said activity and being derived from Proteobacteria. In one embodiment, the homolog of the b1251, b1704, b2600, b2601, b2965, b3281, and/or b3390 is a homolog having said activity and being derived from Gammaproteobacteria. In one embodiment, the homolog of the b1251, b1704, b2600, b2601, b2965, b3281, and/or b3390 is a homolog having said activity and being derived from Enterobacteriales. In one embodiment, the homolog of the b1251, b1704, b2600, b2601, b2965, b3281, and/or b3390 is a homolog having said activity and being derived from Enterobacteriaceae. In one embodiment, the homolog of the b1251, b1704, b2600, b2601, b2965, b3281, and/or b3390 is a homolog having said activity and being derived from *Escherichia*, preferably from *Escherichia coli*.

Homologs of the polypeptide table II, application no. 10, column 3 may be the polypeptides encoded by the nucleic acid molecules indicated in table I, application no. 10, column 7, resp., or may be the polypeptides indicated in table II, application no. 10, column 7, resp.

for the disclosure of this paragraph see paragraph [0038.0.0.0] above.

In accordance with the invention, a protein or polypeptide has the "activity of an protein as shown in table II, application no. 10, column 3" if its de novo activity, or its increased expression directly or indirectly leads to an increased in the level of the fine chemical indicated in the respective line of table II, application no. 10, column 6 "metabolite" in the organism or a part thereof, preferably in a cell of said organism, more preferably in an organelle such as a plastid or mitochondria of said organism. The protein has the above mentioned activities of a protein as shown in table II, application no. 10, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 10, column 3, or which has at least 10% of the original enzymatic activity, preferably 20%, particularly preferably 30%, most particularly preferably 40% in comparison to a protein as shown in the respective line of table II, application no. 10, column 3 of *E. coli*.

for the disclosure of the paragraphs [0040.0.0.9] to [0047.0.0.9] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 10, column 3 its biochemical or genetical causes and the increased amount of the respective fine chemical.

for the disclosure of the paragraphs [0049.0.0.9] to [0051.0.0.9] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 10, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.9] to [0058.0.0.9] see paragraphs [0053.0.0.0] to [0058.0.0.0] above.

In case the activity of the *Escherichia coli* protein b1251 or its homologs, e.g. a "ycil protein" is increased advantageously in an organelle such as a plastid or mitochondria, preferably, in one embodiment an increase of the fine chemical, preferably of alpha-Tocopherol between 35% and 81% or more is conferred.

In case the activity of the *Escherichia coli* protein b1704 or its homologs, e.g. a "3-deoxy-D-arabinoheptulosonate-7-phosphate synthase (DAHP synthetase), tryptophanrepressible" is increased advantageously in an organelle such as a plastid or mitochondria, preferably, in one embodiment an increase of the fine chemical, preferably of alpha-Tocopherol between 25% and 82% or more is conferred.

In case the activity of the *Escherichia coli* protein b1704 or its homologs, e.g. a "3-deoxy-D-arabinoheptulosonate-7-phosphate synthase (DAHP synthetase), tryptophanrepressible" is increased advantageously in an organelle such as a plastid or mitochondria, preferably, in one embodiment an increase of the fine chemical, preferably of gamma-Tocopherol, beta-Tocopherol and 2,3-Dimethyl-5-phytylquinol between 83% and 1547% or more is conferred.

In case the activity of the *Escherichia coli* protein b2600 or its homologs, e.g. a "bifunctional chorismate mutase/prephenate dehydrogenase" is increased advantageously in an organelle such as a plastid or mitochondria, preferably, in one embodiment an increase of the fine chemical, preferably of alpha-Tocopherol between 53% and 88% or more is conferred.

In case the activity of the *Escherichia coli* protein b2600 or its homologs, e.g. a "bifunctional chorismate mutase/prephenate dehydrogenase" is increased advantageously in an organelle such as a plastid or mitochondria, preferably, in one embodiment an increase of the fine chemical, preferably of gamma-Tocotrienol andbeta-Tocotrienol between 677% and 1543% or more is conferred.

In case the activity of the *Escherichia coli* protein b2600 or its homologs, e.g. a "bifunctional chorismate mutase/prephenate dehydrogenase" is increased advantageously in an organelle such as a plastid or mitochondria, preferably, in one embodiment an increase of the fine chemical, preferably of gamma-Tocopherol, beta-Tocopherol and 2,3-Dimethyl-5-phytylquinol between 140% and 464% or more is conferred.

In case the activity of the *Escherichia coli* protein b2600 or its homologs, e.g. a "bifunctional chorismate mutase/prephenate dehydrogenase" is increased advantageously in an organelle such as a plastid or mitochondria, preferably, in one embodiment an increase of the fine chemical, preferably of alpha-Tocotrienol between 68% and 1512% or more is conferred.

In case the activity of the *Escherichia coli* protein b2601 or its homologs, e.g. a "3-deoxy-D-arabinoheptulosonate-7-phosphate (DAHP) synthase" is increased advantageously in an organelle such as a plastid or mitochondria, preferably, in one embodiment an increase of the fine chemical, preferably of alpha-Tocopherol between 56% and 611% or more is conferred.

In case the activity of the *Escherichia coli* protein b2601 or its homologs, e.g. a "3-deoxy-D-arabinoheptulosonate-7-phosphate (DAHP) synthase" is increased advantageously in an organelle such as a plastid or mitochondria, preferably, in one embodiment an increase of the fine chemical, preferably of gamma-Tocopherol, beta-Tocopherol and 2,3-Dimethyl-5-phytylquinol between 63% and 257% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of gamma-Tocopherol, beta-Tocopherol and 2,3-Dimethyl-5-phytylquinol between 203% and 610% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of alpha-Tocopherol between 72% and 204% or more is conferred.

In case the activity of the *Escherichia coli* protein b3281 or its homologs, e.g. a "Shikimate dehydrogenase" is increased advantageously in an organelle such as a plastid or mitochondria, preferably, in one embodiment an increase of the fine chemical, preferably of gamma-Tocopherol, beta-Tocopherol and 2,3-Dimethyl-5-phytylquinol between 38% and 164% or more is conferred.

In case the activity of the *Escherichia coli* protein b3390 or its homologs, e.g. a "shikimate kinase I" is increased advantageously in an organelle such as a plastid or mitochondria, preferably, in one embodiment an increase of the fine chemical, preferably of alpha-Tocopherol between 62% and 68% or more is conferred.

In case the activity of the *Escherichia coli* protein b3390 or its homologs, e.g. a "shikimate kinase I" is increased advantageously in an organelle such as a plastid or mitochondria, preferably, in one embodiment an increase of the fine chemical, preferably of gamma-Tocopherol, beta-Tocopherol and 2,3-Dimethyl-5-phytylquinol between 41% and 86% or more is conferred.

In one embodiment, the activity of any on of the *Escherichia coli* proteins b1251, b1704, b2600, b2601, b2965, b3281, and/or b3390 f or their homologs," is advantageously increased in an organelle such as a plastid or mitochondria, preferably conferring an increase of the fine chemical indicated in column 6 "metabolites" for application no. 10 in any one of Tables I to IV, resp., for the disclosure of the paragraphs [0061.0.0.9] and [0062.0.0.9] see paragraphs [0061.0.0.0] and [0062.0.0.0] above.

A protein having an activity conferring an increase in the amount or level of the fine chemical, preferably upon targeting to the plastids, has in one embodiment the structure of the polypeptide described herein, in particular of the polypeptides comprising the consensus sequence shown in table IV, application no. 10, column 7 or of the polypeptide as shown in the amino acid sequences as disclosed in table II, application no. 10, columns 5 and 7 or the functional homologues thereof as described herein, or is encoded by the nucleic acid molecule characterized herein or the nucleic acid molecule according to the invention, for example by the nucleic acid molecule as shown in table I, application no. 10, columns 5 and 7 or its herein described functional homologues and has the herein mentioned activity.

For the purposes of the present invention, the reference to the fine chemical, e.g. to the term "vitamin E", also encompasses the corresponding salts, such as, for example, the potassium or sodium salts or the salts with amines such as diethylamine as well as triglycerides, lipids, oils and/or fats containing the respective fine chemical, e.g. vitamin E, alpha-, beta-, gamma-tocopherol, alpha-, beta-tocotrienol or the precursor 2,3-Dimethyl-5-phytylquinol for the disclosure of the paragraphs [0065.0.0.9] and [0066.0.0.9] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 10, columns 5 and 7 or its homologs activity having herein-mentioned vitamin E increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 10, columns 5 and 7, e.g. a nucleic acid sequence encoding a polypeptide having the activity of a protein as indicated in table II, application no. 10, columns 5 and 7 or its homologs activity or of a mRNA encoding the polypeptide of the present invention having herein-mentioned vitamin E increasing activity; and/or c) increasing the specific activity of a protein conferring the increased expression of a protein encoded by the nucleic acid molecule of the invention or of the polypeptide of the present invention having herein-mentioned vitamin E increasing activity, e.g. of a polypeptide having the activity of a protein as indicated in table II, application no. 10, columns 5 and 7 or its homologs activity, or decreasing the inhibitiory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned vitamin E increasing activity, e.g. of a polypeptide having the activity of a protein as indicated in table II, application no. 10, columns 5 and 7 or its homologs activity; and/or e) stimulating activity of a protein conferring the increased expression of a protein encoded by the nucleic acid molecule of the present invention or a polypeptide of the present invention having herein-mentioned vitamin E increasing activity, e.g. of a polypeptide having the activity of a protein as indicated in table II, application no. 10, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned vitamin E increasing activity, e.g. of a polypeptide having the activity of a protein as indicated in table II, application no. 10, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned vitamin E increasing activity, e.g. of a polypeptide having the activity of a protein as indicated in table II, application no. 10, columns 5 and 7 or its homologs activity; and/or h) increasing the expression of the endogenous gene encoding the polypeptide of the invention, e.g. a polypeptide having the activity of a protein as indicated in table II, application no. 10, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned vitamin E increasing activity, e.g. of polypeptide having the activity of a protein as indicated in table II, application no. 10, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned vitamin E increasing activity, e.g. of a polypeptide having the activity of a protein as indicated in table II, application no. 10, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned vitamin E increasing activity, e.g. of a polypeptide having the activity of a protein as indicated in table II, application no. 10, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the respective fine chemical as indicated in column 6 of application no. 10 in Table I to IV, resp., after increasing the expression or activity of the encoded polypeptide preferably in organelles such as plastids or having the activity of a polypeptide having an activity as the protein as shown in table II, application no. 10, column 3 or its homologs. Preferably the increase of the fine chemical takes place in plastids.

for the disclosure of the paragraphs [0069.0.0.9] to [0079.0.0.9] see paragraphs [0069.0.0.0] to [0079.0.0.0] above.

The activation of an endogenous polypeptide having above-mentioned activity, e.g. having the activity of a protein as shown in table II, application no. 10, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 10, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 10, column 3. The expression of the chimeric transcription factor in a organism, in particular in a plant, leads to a specific expression of the protein as shown in table II, application no. 10, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.9] to [0084.0.0.9] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous vitamin composition comprising a higher content of (from a viewpoint of nutritional physiology limited) vitamins, like vitamin A, B, E; etc., or its precursor like 2,3-dimethyl-5-phytylquinol.

for the disclosure of this paragraph see paragraph [0086.0.0.0] above.

By influencing the metabolism thus, it is possible to produce, in the process according to the invention, further advantageous compounds. Examples of such compounds are vitamin E or its precursor 2,3-dimethyl-5-phytylquinol, further vitamins or provitamins or carotenoids.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 10, column 3 or of a polypeptide being encoded by the nucleic acid molecule of the present invention and described below, e.g. conferring an increase of the respective fine chemical as indicated in any one of Tables I to IV, application no. 10, column 6 "metabolite" in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and d) if desired, recovering, optionally isolating, the respective free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the respective fine chemical but as option it is also possible to produce, recover and, if desired isolate, other free or/and bound carotenoids, vitamins, provitamins etc.

for the disclosure of the paragraphs [0090.0.0.9] to [0097.0.0.9] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 10, columns 5 and 7 or a derivative thereof, or b) a genetic regulatory element, for example a promoter, which is functionally linked to the nucleic acid sequence as shown table I, application no. 10, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 10, columns 5 and 7 joined to a nucleic acid sequence encoding a transit peptide, or a targeting nucleic acid sequence which directs the nucleic acid sequences disclosed in table I, application no. 10, columns 5 and 7 to the organelle preferentially the plastids. Altenatively the inventive nucleic acids sequences consist advantageously of the nucleic acid sequences as depicted in the sequence protocol and disclosed in table I, application no. 10, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose vitamin E content is modified advantageously owing to the nucleic acid molecule of the present invention expressed. This is important for plant breeders since, for example, the nutritional value of plants for poultry is dependent on the abovementioned vitamin E as vitamin source in feed. Further, this is also important for the production of cosmetic compostions since, for example, the antioxidant level of plant extracts is depending on the abovementioned vitamin E and the general amount of vitamins e.g. as antioxidants.

After the activity of the protein as shown in table II, application no. 10, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.9] to [0110.0.0.9] see paragraphs [0102.0.0.0] to [0110.0.0.0] above.

In a preferred embodiment, the respective fine chemical (vitamin E or its precursor 2,3-dimethyl-5-phytylquinol) is produced in accordance with the invention and, if desired, is isolated. The production of further vitamins, provitamins or carotenoids, e.g. carotenes or xanthophylls, or mixtures thereof or mixtures with other compounds by the process according to the invention is advantageous.

Thus, the content of plant components and preferably also further impurities is as low as possible, and the abovementioned vitamin E or its precursor 2,3-dimethyl-5-phytylquinol are obtained in as pure form as possible. In these applications, the content of plant components advantageously amounts to less than 10%, preferably 1%, more preferably 0.1%, very especially preferably 0.01% or less.

In another preferred embodiment of the invention a combination of the increased expression of the nucleic acid sequence or the protein of the invention together with the transformation of a protein or polypeptide or a compound, which functions as a sink for the desired fine chemical, for example vitamin E or its precursor 2,3-dimethyl-5-phytylquinol in the organism, is useful to increase the production of the respective fine chemical.

In the case of the fermentation of microorganisms, the above-mentioned vitamin E or its precursor 2,3-dimethyl-5-phytylquinol may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, spray granulation or by other methods. Preferably the respective fine chemical or the vitamin E or its precursor 2,3-dimethyl-5-phytylquinol comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the vitamin E or its precursor 2,3-dimethyl-5-phytylquinol such as alpha, beta, or gamma-tocopherol, synthesized in the process according to the invention can advantageously be marketed directly without there being any need for vitamin E or its precursor 2,3-dimethyl-5-phytylquinol synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

The site of vitamin E biosynthesis in plants is, inter alia, the leaf tissue so that the isolation of leafs makes sense. However, this is not limiting, since the expression may also take place in a tissue-specific manner in all of the remaining parts of the plant, in particular in fat-containing seeds. A further preferred embodiment therefore relates to a seed-specific isolation of vitamin E or its precursor 2,3-dimethyl-5-phytylquinol. However, the respective fine chemical produced in the process according to the invention can also be isolated from the organisms, advantageously plants, in the form of their oils, fats, lipids as extracts, e.g. ether, alcohol, or other organic solvents or water containing extract and/or free vitamin E or its precursor 2,3-dimethyl-5-phytylquinol. The respective fine chemical produced by this process can be obtained by harvesting the organisms, either from the crop in which they grow, or from the field. This can be done via pressing or extraction of the plant parts, preferably the plant seeds. To increase the efficiency of oil extraction it is beneficial to clean, to temper and if necessary to hull and to flake the plant material especially the seeds. e.g. the oils, fats, lipids, extracts, e.g. ether, alcohol, or other organic solvents or water containing extract and/or free vitamin E or its precursor 2,3-dimethyl-5-phytylquinol can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as preferably warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid.

Because vitamin E or its precursor 2,3-dimethyl-5-phytylquinol in microorganisms may be localized intracellularly, their recovery essentials comes down to the isolation of the biomass. Well-establisthed approaches for the harvesting of cells include filtration, centrifugation and coagulation/flocculation as described herein. Determination of tocoherols in cells has been described by Tan and Tsumura 1989, see also Biotechnology of Vitamins, Pigments and Growth Factors, Edited by Erik J. Vandamme, London, 1989, p.96 to 103. Many further methods to determine the tocopherol content are known to the person skilled in the art.

Vitamin E or its precursor 2,3-dimethyl-5-phytylquinol can for example be analyzed advantageously via HPLC or GC separation methods and detected by MS oder MSMS methods. The unambiguous detection for the presence of Vitamin E or its precursor 2,3-dimethyl-5-phytylquinol containing products can be obtained by analyzing recombinant organisms using analytical standard methods: GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). The material to be analyzed can be disrupted by sonication, grinding in a glass mill, liquid nitrogen and grinding, cooking, or via other applicable methods; see also Biotechnology of Vitamins, Pigments and Growth Factors, Edited by Erik J. Vandamme, London, 1989, p.96 to 103.

In a preferred embodiment, the present invention relates to a process for the production of the respective fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 10, columns 5 and 7 or a fragment thereof, which confers an increase in the amount of the respective fine chemical in an organism or a part thereof;
b) nucleic acid molecule comprising, preferably at least the mature form, of the nucleic acid molecule shown in table I, application no. 10, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;
e) nucleic acid molecule which hybidizes with a nucleic acid molecule of (a) to (c) under stringent hybridisation conditions and conferring an increase in the amount of the respective fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;
h) nucleic acid molecule comprising a nucleic acid molecule which is obtained by amplifying nucleic acid molecules from a cDNA library or a genomic library using the primers shown in table III, application no. 10, column 7 and conferring an increase in the amount of the respective fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;
j) nucleic acid molecule which encodes a polypeptide comprising the consensus sequence shown in table IV, application no. 10, column 7 and conferring an increase in the amount of the respective fine chemical in an organism or a part thereof;
k) nucleic acid molecule comprising one or more of the nucleic acid molecule encoding the amino acid sequence of a polypeptide encoding a domain of the polypeptide shown in table II, application no. 10, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in table IA, application no. 10, columns 5 and 7 by one or more nucleotides. In one embodiment, the nucleic acid molecule used in the process of the invention does not consist of the sequence indicated in table IA, application no. 10, columns 5 and 7. In one embodiment, the nucleic acid molecule used in the process of the invention is less than 100%, 99.999%, 99.99%, 99.9% or 99% identical to a sequence indicated in table IA, application no. 10, columns 5 and 7. In another embodiment, the nucleic acid molecule does not encode a polypeptide of a sequence indicated in table IIA, application no. 10, columns 5 and 7.

In one embodiment, the nucleic acid molecule used in the process of the invention distinguishes over the sequence indicated in table IB, application no. 10, columns 5 and 7, by one or more nucleotides. In one embodiment, the nucleic acid molecule used in the process of the invention does not consist of the sequence indicated in table IB, application no. 10, columns 5 and 7. In one embodiment, the nucleic acid molecule used in the process of the invention is less than 100%, 99.999%, 99.99%, 99.9% or 99% identical to a sequence indicated in table IB, application no. 10, columns 5 and 7. In another embodiment, the nucleic acid molecule does not encode a polypeptide of a sequence indicated in table IIB, application no. 10, columns 5 and 7.

In one embodiment, the nucleic acid molecule used in the process distinguishes over the sequence shown in table I, application no. 10, columns 5 and 7 by one or more nucleotides or does not consist of the sequence shown in table I, application no. 10, columns 5 and 7. In one embodiment, the nucleic acid molecule of the present invention is less than 100%, 99.999%, 99.99%, 99.9% or 99% identical to the sequence shown in table I, application no. 10, columns 5 and 7. In another embodiment, the nucleic acid molecule does not encode a polypeptide of the sequence shown in table II, application no. 10, columns 5 and 7.

for the disclosure of the paragraphs [0118.0.0.9] to [0120.0.0.9] see paragraphs [0118.0.0.0] to [0120.0.0.0] above.

The expression of nucleic acid molecules with the sequence shown in table I, application no. 10, columns 5 and 7, or nucleic acid molecules which are derived from the amino acid sequences shown in table II, application no. 10, columns 5 and 7 or from polypeptides comprising the consensus sequence shown in table IV, application no. 10, column 7, or their derivatives or homologues encoding polypeptides with the enzymatic or biological activity of a protein as shown in table II, application no. 10, column 3, and conferring an increase of the respective fine chemical (column 6 of application no. 10 in any one of Tables I to IV) after increasing its plastidic and/or specific activity in the plastids is advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 10, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 10, column 3 and which confer an increase in the level of the respective fine chemical indicated in table II, application no. 10, column 6 by being expressed either in the cytsol or in an organelle such as a plastid or mitochondria or both, preferably in plastids, and the gene product being localized in the plastid and other parts of the cell or in the plastid as described above.

for the disclosure of the paragraphs [0126.0.0.9] to [0133.0.0.9] see paragraphs [0126.0.0.0] to [0133.0.0.0] above.

Production strains which are also advantageously selected in the process according to the invention are microorganisms selected from the group of green algae, like *Spongioccoccum exentricum, Chlorella sorokiniana* (pyrenoidosa, Jul. 11, 2005), or algae of the genus *Haematococcus, Phaedactylum tricomatum, Volvox* or *Dunaliella* or form the group of fungi like fungi belonging to the *Daccrymycetaceae* family, or non-photosynthetic bacteria, like methylotrophs, flavobacteria, actinomycetes, like streptomyces chrestomyceticus, Mycobacteria like *Mycobacterim phlei*, or *Rhodobacter capsulatus*. Thus, the invention also contemplates embodiments in which a host lacks vitamin E or its precursor 2,3-dimethyl-5-phytylquinol or other vitamin E or its precursor 2,3-dimethyl-5-phytylquinol precursors, such as the vinca. In a plant of the latter type, the inserted DNA includes genes that code for proteins producing vitamin E precursors (compounds that can be converted biologically into a compound with vitamin E activity) and one or more modifying enzymes which were originally absent in such a plant.

The invention also contemplates embodiments in which the vitamin E or its precursor 2,3-dimethyl-5-phytylquinol, or other vitamin E precursor compounds in the production of the respective fine chemical, is present in the phytosynthtically active organisms chosen as the host; for example, cyanobacteria, moses, algae or plants which, even as a wild type, are capable of producing vitamin E.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 10, columns 5 and 7 or the functional homologues thereof as described herein, preferably conferring above-mentioned activity, i.e. conferring an increase of the respective fine chemical after increasing its plastidic activity, e.g. after increasing the activity of a protein as shown in table II, application no. 10, column 3 by—for example—expression either in the cytsol or in an organelle such as a plastid or mitochondria or both, preferably in plastids and the gene product, e.g. the polypeptide, being localized in the plastid and other parts of the cell or in the plastid as described above.

for the disclosure of the paragraphs [0135.0.0.9] to [0140.0.0.9] see paragraphs [0135.0.0.0] to [0140.0.0.0] above.

Synthetic oligonucleotide primers for the amplification, e.g. as shown in table III, application no. 10, column 7, by means of polymerase chain reaction can be generated on the basis of a sequence shown herein, for example the sequence shown in table I, application no. 10, columns 5 and 7 or the sequences derived from table II, application no. 10, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 10, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 10, column 3 or further functional homologs of the polypeptide of the invention from other organisms.

for the disclosure of the paragraphs [0144.0.0.9] to [0151.0.0.9] see paragraphs [0144.0.0.0] to [0151.0.0.0] above.

Polypeptides having above-mentioned activity, i.e. conferring the increase of the respective fine chemical indicated in table I, application no. 10, column 6, and being derived from other organisms, can be encoded by other DNA sequences which hybridize to the sequences shown in table I, application no. 10, columns 5 and 7, preferably of table IB, application no. 10, columns 5 and 7 under relaxed hybridization conditions and which code on expression for peptides having the respective fine chemical, i.e. vitamin E or its precursor 2,3-dimethyl-5-phytylquinol resp., in particular, of alpha-, beta-, and/or gamma-tocopherol, resp., increasing activity.

for the disclosure of the paragraphs [0153.0.0.9] to [0159.0.0.9] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 10, columns 5 and 7, preferably shown in table IB, application no. 10, columns 5 and 7 is one which is sufficiently complementary to one of the nucleotide sequences shown in table I, application no. 10, columns 5 and 7, preferably shown in table IB, application no. 10, columns 5 and 7 such that it can hybridize to one of the nucleotide sequences shown in table I, application no. 10, columns 5 and 7, preferably shown in table IB, application no. 10, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 10, columns 5 and 7, preferably shown in table IB, application no. 10, columns 5 and 7, or a portion thereof and preferably has above mentioned activity, in particular having a respective fine chemical increasing activity after increasing the activity or an activity of a gene product as shown in table II, application no. 10, column 3 by for example expression either in the cytsol or in an organelle such as a plastid or mitochondria or both, preferably in plastids, and the gene product, e.g. the polypeptide, being localized in the plastid and other parts of the cell or in the plastid as described above.

The nucleic acid molecule of the invention comprises a nucleotide sequence which hybridizes, preferably hybridizes under stringent conditions as defined herein, to one of the nucleotide sequences shown in table I, application no. 10, columns 5 and 7, preferably shown in table IB, application no. 10, columns 5 and 7, or a portion thereof and encodes a protein having above-mentioned activity, e.g. conferring of a vitamin E, triglycerides, lipids, oils and/or fats containing vitamin E increase by for example expression either in the cytsol or in an organelle such as a plastid or mitochondria or both, preferably in plastids, and optionally, the activity of a protein as shown in table II, application no. 10, column 3, and the gene product, e.g. the polypeptide, being localized in the plastid and other parts of the cell or in the plastid as described above.

Moreover, the nucleic acid molecule of the invention can comprise only a portion of the coding region of one of the sequences shown in table I, application no. 10, columns 5 and 7, preferably shown in table IB, application no. 10, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the respective fine chemical indicated in Table I, application no. 10, column 6, if its activity is increased by for example expression either in the cytsol or in an organelle such as a plastid or mitochondria or both, preferably in plastids, and the gene product, e.g. the polypeptide, being localized in the plastid and other parts of the cell or in the plastid as described above. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 10, columns 5 and 7, an anti-sense sequence of one of the sequences, e.g., set forth in table I, application no. 10, columns 5 and 7, preferably shown in table IB, application no. 10, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 10, column 7 will result in a fragment of the gene product as shown in table II, column 3.

for the disclosure of this paragraph see paragraph [0164.0.0.0] above. [0165.0.9.9] The nucleic acid molecule of the invention encodes a polypeptide or portion thereof which includes an amino acid sequence which is sufficiently homologous to the amino acid sequence shown in table II, application no. 10, columns 5 and 7 such that the protein or portion thereof maintains the ability to participate in the fine chemical production, in particular an activity increasing the level of vitamin E or its precursor 2,3-dimethyl-5-phytylquinol resp., in particular, of alpha-, beta-, and/or gamma-tocopherol, resp., increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 10, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 10, columns 5 and 7 and having above-mentioned activity, e.g. conferring preferably the increase of the respective fine chemical by for example expression either in the cytsol or in an organelle such as a plastid or mitochondria or both, preferably in plastids, and the gene product, e.g. the polypeptide, being localized in the plastid and other parts of the cell or in the plastid as described above.

for the disclosure of the paragraphs [0168.0.0.9] and [0169.0.0.9] see paragraphs [0168.0.0.0] and [0169.0.0.0] above.

The invention further relates to nucleic acid molecules that differ from one of the nucleotide sequences shown in table I, application no. 10, columns 5 and 7 (and portions thereof due to degeneracy of the genetic code and thus encode a polypeptide of the present invention, in particular a polypeptide having above mentioned activity, e.g. conferring an increase in the respective fine chemical in a organism, e.g. as that polypeptides depicted by the sequence shown in table II, application no. 10, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 10, columns 5 and 7 or the functional homologues. In a still further embodiment, the nucleic acid molecule of the invention encodes a full length protein which is substantially homologous to an amino acid sequence shown in table II, application no. 10, columns 5 and 7 or the functional homologues. However, in a preferred embodiment, the nucleic acid molecule of the present invention does not consist of the sequence shown in table I, application no. 10, columns 5 and 7, preferably as indicated in table IA, application no. 10, columns 5 and 7. Preferably the nucleic acid molecule of the invention is a functional homologue or identical to a nucleic acid molecule indicated in table IB, application no. 10, columns 5 and 7.

for the disclosure of the paragraphs [0171.0.0.91 to [0173.0.0.9] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 10, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 10, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 10, columns 5 and 7.

for the disclosure of the paragraphs [0179.0.0.9] and [0180.0.0.9] see paragraphs [0179.0.0.0] and [0180.0.0.0] above.

Accordingly, the invention relates to nucleic acid molecules encoding a polypeptide having above-mentioned activity, e.g. conferring an increase in the the respective fine chemical in an organisms or parts thereof by for example expression either in the cytsol or in an organelle such as a plastid or mitochondria or both, preferably in plastids (as described), that contain changes in amino acid residues that are not essential for said activity. Such polypeptides differ in amino acid sequence from a sequence contained in the sequences shown in table II, application no. 10, columns 5 and 7, preferably shown in table IIA, application no. 10, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 10, columns 5 and 7, preferably shown in table IIA, application no. 10, columns 5 and 7 and is capable of participation in the increase of production of the fine chemical after increasing its activity, e.g. its expression by for example expression either in the cytsol or in an organelle such as a plastid or mitochondria or both, preferably in plastids and the gene product, e.g. the polypeptide, being localized in the plastid and other parts of the cell or in the plastid as described above. Preferably, the protein encoded by the nucleic acid molecule is at least about 60% identical to the sequence shown in table II, application no. 10, columns 5 and 7, preferably shown in table IIA, application no. 10, columns 5 and 7, more preferably at least about 70% identical to one of the sequences shown in table II, application no. 10, columns 5 and 7, preferably shown in table IIA, application no. 10, columns 5 and 7, even more preferably at least about 80%, 90%, 95% homologous to the sequence shown in table II, application no. 10, columns 5 and 7, preferably shown in table IIA, application no. 10, columns 5 and 7, and most preferably at least about 96%, 97%, 98%, or 99% identical to the sequence shown in table II, application no. 10, columns 5 and 7, preferably shown in table II A, application no. 10, columns 5 and 7.

for the disclosure of the paragraphs [0182.0.0.9] to [0188.0.0.9] see paragraphs [0182.0.0.0] to [0188.0.0.0] above.

Functional equivalents derived from one of the polypeptides as shown in table II, application no. 10, columns 5 and 7, preferably shown in table IIB, application no. 10, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 10, columns 5 and 7, preferably shown in table IIB, application no. 10, columns 5 and 7 resp., according to the invention and are distinguished by essentially the same properties as the polypeptide as shown in table II, application no. 10, columns 5 and 7, preferably shown in table IIB, application no. 10, columns 5 and 7.

Functional equivalents derived from the nucleic acid sequence as shown in table I, application no. 10, columns 5 and 7, preferably shown in table IB, application no. 10, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 10, columns 5 and 7, preferably shown in table IIB, application no. 10, columns 5 and 7 resp., according to the invention and encode polypeptides having essentially the same properties as the polypeptide as shown in table II, application no. 10, columns 5 and 7, preferably shown in table IIB, application no. 10, columns 5 and 7.

for the disclosure of this paragraph see paragraph [0191.0.0.0] above.

A nucleic acid molecule encoding an homologous to a protein sequence of table II, application no. 10, columns 5 and 7, preferably shown in table IIB, application no. 10, columns 5 and 7 resp., can be created by introducing one or more nucleotide substitutions, additions or deletions into a nucleotide sequence of the nucleic acid molecule of the present invention, in particular of table I, application no. 10, columns 5 and 7, preferably shown in table IB, application no. 10, columns 5 and 7 resp., such that one or more amino acid substitutions, additions or deletions are introduced into the encoded protein. Mutations can be introduced into the encoding sequences of table I, application no. 10, columns 5 and 7, preferably shown in table IB, application no. 10, columns 5 and 7 resp., by standard techniques, such as site-directed mutagenesis and PCR-mediated mutagenesis.

for the disclosure of the paragraphs [0193.0.0.9] to [0196.0.0.9] see paragraphs [0193.0.0.0] to [0196.0.0.0] above.

Homologues of the nucleic acid sequences used, with the sequence shown in table I, application no. 10, columns 5 and 7, preferably shown in table IB, application no. 10, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 10, columns 5 and 7, preferably shown in table IB, application no. 10, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 10, columns 5 and 7, preferably shown in table IB, application no. 10, columns 5 and 7. It is preferred that the nucleic acid molecule comprises as little as possible other nucleotides not shown in any one of table I, application no. 10, columns 5 and 7, preferably shown in table IB, application no. 10, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 10, columns 5 and 7, preferably shown in table IB, application no. 10, columns 5 and 7.

Also preferred is that the nucleic acid molecule used in the process of the invention encodes a polypeptide comprising the sequence shown in table II, application no. 10, columns 5 and 7, preferably shown in table IIB, application no. 10, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 10, columns 5 and 7, preferably shown in table IIB, application no. 10, columns 5 and 7.

In one embodiment, the nucleic acid molecule of the invention or used in the process encodes a polypeptide comprising the sequence shown in table II, application no. 10, columns 5 and 7, preferably shown in table IIB, application no. 10, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 10, columns 5 and 7, preferably shown in table IB, application no. 10, columns 5 and 7.

Polypeptides (=proteins), which still have the essential biological or enzymatic activity of the polypeptide of the present invention conferring an increase of the respective fine chemical indicated in column 6 of Table I, application no. 10, i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 10, columns 5 and 7 expressed under identical conditions.

Homologues of table I, application no. 10, columns 5 and 7 or of the derived sequences of table II, application no. 10, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.9] to [0215.0.0.9] see paragraphs [0203.0.0.0] to [0215.0.0.0] above.

Accordingly, in one embodiment, the invention relates to a nucleic acid molecule, which comprises a nucleic acid molecule selected from the group consisting of:
a) nucleic acid molecule encoding, preferably at least the mature form, of the polypeptide shown in table II, application no. 10, columns 5 and 7, preferably in table IIB, application no. 10, columns 5 and 7; or a fragment thereof conferring an increase in the amount of the fine chemical according to table IIB, application no. 10, column 6 in an organism or a part thereof b) nucleic acid molecule comprising, preferably at least the mature form, of the nucleic acid molecule shown in table I, application no. 10, columns 5 and 7, preferably in table IB, application no. 10, columns 5 and 7 or a fragment thereof conferring an increase in the amount of the fine chemical according to table IIB, application no. 10, column 6 in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical according to table IIB, application no. 10, column 6 in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical according to table IIB, application no. 10, column 6 in an organism or a part thereof;

e) nucleic acid molecule which hybridizes with a nucleic acid molecule of (a) to (c) under stringent hybridisation conditions and conferring an increase in the amount of the fine chemical according to table IIB, application no. 10, column 6 in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical according to table IIB, application no. 10, column 6 in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical according to table IIB, application no. 10, column 6 in an organism or a part thereof;

h) nucleic acid molecule comprising a nucleic acid molecule which is obtained by amplifying a cDNA library or a genomic library using the primers in table III, application no. 10, column 7 and conferring an increase in the amount of the fine chemical according to table IIB, application no. 10, column 6 in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 10, column 7 and conferring an increase in the amount of the fine chemical in an organism or a part thereof;

k) nucleic acid molecule encoding the amino acid sequence of a polypeptide encoding a domaine of the polypeptide shown in table II, application no. 10, columns 5 and 7 and conferring an increase in the amount of the fine chemical according to table IIB, application no. 10, column 6 in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 10, columns 5 and 7 or a nucleic acid molecule encoding, preferably at least the mature form of, the polypeptide shown in table II, application no. 10, columns 5 and 7, and conferring an increase in the amount of the fine chemical according to table IIB, application no. 10, column 6 in an organism or a part thereof; or which encompasses a sequence which is complementary thereto;

whereby, preferably, the nucleic acid molecule according to (a) to (l) distinguishes over the sequence depicted in table IA and/or IB, application no. 10, columns 5 and 7 by one or more nucleotides. In one embodiment, the nucleic acid molecule of the invention does not consist of the sequence shown in table IA and/or IB, application no. 10, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 10, columns 5 and 7. In a further embodiment the nucleic acid molecule does not encode the polypeptide sequence shown in table IIA and/or IIB, application no. 10, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 10, columns 5 and 7 does not encode a protein of the sequence shown in table IIA and/or IIB, application no. 10, columns 5 and 7. Accordingly, in one embodiment, the protein encoded by a sequence of a nucleic acid accoriding to (a) to (l) does not consist of the sequence shown in table IA and/or IB, application no. 10, columns 5 and 7. In a further embodiment, the protein of the present invention is at least 30% identical to protein sequence depicted in table IIA and/or IIB, application no. 10, columns 5 and 7 and less than 100%, preferably less than 99.999%, 99.99% or 99.9%, more preferably less than 99%, 985, 97%, 96% or 95% identical to the sequence shown in table IIA and/or IIB, application no. 10, columns 5 and 7.

for the disclosure of the paragraphs [0217.0.0.9] to [0226.0.0.9] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 10, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.9] to [0239.0.0.9] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 10, columns 5 and 7 or its derivatives, it is advantageous additionally to express and/or mutate further genes in the organisms. Especially advantageously, additionally at least one further gene of the tocopherol biosynthetic pathway such as for a vitamin E precursor, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the sequences shown in Table I, application no. 10, columns 5 and 7 with genes which generally support or enhances to growth or yield of the target organism, for example genes which lead to faster growth rate of microorganisms or genes which produces stress-, pathogen-, or herbicide resistant plants.

In a further embodiment of the process of the invention, therefore, organisms are grown, in which there is simultaneous overexpression of at least one nucleic acid or one of the genes which code for proteins involved in the tocopherol metabolism, in particular in synthesis of alpha-, beta-, and/or gamma-tocopherol.

Further advantageous nucleic acid sequences which can be expressed in combination with the sequences used in the process and/or the above-mentioned biosynthesis genes are the sequences encoding further genes of the tocopherol biosynthetic pathway, such as the homogentisate phytyltransferase (HPT) or the enzymes catalysing the subsequent cyclization and methylation reactions, γ-tocopherol methyl transferase (γ-TMT), prenyltransferases that condense prenyl groups with allylic chains and those that condense prenyl chains with aromatic groups and others. These genes can lead to an increased synthesis of the essential vitamin E or its precursor 2,3-dimethyl-5-phytylquinol resp., in particular, of the fine chemical indicated in column 6 of any one of Tables I to IV.

In a further advantageous embodiment of the process of the invention, the organisms used in the process are those in which simultaneously a vitamin E degrading protein is attenuated, in particular by reducing the rate of expression of the corresponding gene.

The respective fine chemical produced can be isolated from the organism by methods with which the skilled worker is familiar. For example, via extraction, salt precipitation, and/or different chromatography methods. The process according to the invention can be conducted batchwise, semibatchwise or continuously. The respective fine chemical produced by this process can be obtained by harvesting the organisms, either from the crop in which they grow, or from the field. This can be done via pressing or extraction of the plant parts.

for the disclosure of the paragraphs [0243.0.0.9] to [0264.0.0.9] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 10, columns 5 and 7 and described herein to achieve an expression in one of said compartments or extracellular.

for the disclosure of the paragraphs [0266.0.0.9] to [0287.0.0.9] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 10, columns 5 and 7 or their homologs is functionally linked to a plastidial targeting sequence. A further preferred embodiment of the invention relates to a vector in which a nucleic acid sequence encoding one of the polypeptides shown in table II, application no. 10, columns 5 and 7 or their homologs is functionally linked to a regulatory sequences which permit the expression in plastids.

for the disclosure of the paragraphs [0289.0.0.9] to [0296.0.0.9] see paragraphs [0289.0.0.0] to [0296.0.0.0] above.

Moreover, a native polypeptide conferring the increase of the respective fine chemical in an organism or part thereof can be isolated from cells (e.g., endothelial cells), for example using the antibody of the present invention as described herein, in particular, an antibody against polypeptides as shown in table II, application no. 10, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 10, columns 5 and 7 or as coded by the nucleic acid molecule shown in table I, application no. 10, columns 5 and 7 or functional homologues thereof.

In one advantageous embodiment, in the method of the present invention the activity of a polypeptide is increased comprising or consisting of the consensus sequence shown in table IV, application no. 10, columns 7 and in one another embodiment, the present invention relates to a polypeptide comprising or consisting of the consensus sequence shown in table IV, application no. 10, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.9] to [0304.0.0.9] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 10, columns 5 and 7 by one or more amino acids. In one embodiment, polypeptide distinguishes form the sequence shown in table IIA and/or IIB, application no. 10, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 10, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 10, columns 5 and 7.

for the disclosure of this paragraph see paragraph [0306.0.0.0] above.

In one embodiment, the invention relates to polypeptide conferring an increase of level of the respective fine chemical indicated in Table IIA and/or IIB, application no. 10, column 6 in an organism or part being encoded by the nucleic acid molecule of the invention or used in the process of the invention and having a sequence which distinguishes from the sequence as shown in table IIA and/or IIB, application no. 10, columns 5 and 7 by one or more amino acids. In another embodiment, said polypeptide of the invention does not consist of the sequence shown in table IIA and/or IIB, application no. 10, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 10, columns 5 and 7.

In one embodiment, the present invention relates to a polypeptide having the activity of the protein as shown in table IIA and/or IIB, application no. 10, column 3, which distinguishes over the sequence depicted in table IIA and/or IIB, application no. 10, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle, for example into the plastid or mitochondria.

for the disclosure of the paragraphs [0309.0.0.9] to [0311.0.0.9] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 10, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 10, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 10, columns 5 and 7 or which is homologous thereto, as defined above.

Accordingly the polypeptide of the present invention can vary from the sequences shown in table IIA and/or IIB, application no. 10, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 10, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 10, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 10, column 3. Differences shall mean at least one amino acid different from the sequences as shown in table II, application no. 10, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 10, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 10, column 3. The nucleic acid molecules and polypeptide molecules of the invention are expressed such that the yield, production, and/or efficiency of production of a desired compound is improved.

Preferably, the compound is a composition comprising the essentially pure fine chemical, i.e. Vitamin E, i.e. alpha-tocopherol, beta-tocopherol, and/or gamma-tocopherol or the vitamin E precursor 2,3-Dimethyl-5-pythylquinol, respectively or a recovered or isolated Vitamin E, i.e. alpha-tocopherol, beta-tocopherol, and/or gamma-tocopherol or the vitamin E precursor 2,3-Dimethyl-5-pythylquinol, respectively, e.g. in free or in protein- or membrane-bound form.

for the disclosure of the paragraphs [0320.0.0.9] to [0322.0.0.9] see paragraphs [0320.0.0.0] to [0322.0.0.0] above.

In one embodiment, a protein (=polypeptide) as shown in table II, application no. 10, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 10, column 3, e.g., a protein which does not confer the activity described herein and which is derived from the same or a different organism.

for the disclosure of the paragraphs [0324.0.0.9] to [0329.0.0.9] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 10, columns 5 and 7.

for the disclosure of the paragraphs [0331.0.0.9] to [0346.0.0.9] see paragraphs [0331.0.0.0] to [0346.0.0.0] above.

Accordingly the present invention relates to any cell transgenic for any nucleic acid characterized as part of the invention, e.g. conferring the increase of the respective fine chemical indicated in column 6 of application no. 10 in any one of Tables I to IV in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 10, column 3. Due to the above mentioned activity the respective fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 10, column 3 or a protein as shown in table II, application no. 10, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 10, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.9] to [0358.0.0.9] see paragraphs [0350.0.0.0] to [0358.0.0.0] above.

Transgenic plants comprising the respective fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The respective fine chemical indicated in column 6 of any one of Tables I to IV, application no. 10, e.g. itamin E or its precursor 2,3-dimethyl-5-phytylquinol resp., in particular, alpha-, beta-, and/or gamma-tocopherol resp., and being produced in the process according to the invention may, however, also be isolated from the plant and can be isolated by harvesting the plants either from the culture in which they grow or from the field. This can be done for example via expressing, grinding and/or extraction of the plant parts, preferably the plant seeds, plant fruits, plant tubers and the like.

for the disclosure of the paragraphs [0360.0.0.9] to [0362.0.0.9] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the respective fine chemical produced in the process can be isolated. The resulting composition or fraction comprising the respective fine chemical can, if appropriate, subsequently be further purified, if desired mixed with other active ingredients such as fatty acids, vitamins, amino acids, carbohydrates, antibiotics, covitamins, antioxidants, carotenoids, and the like, and, if appropriate, formulated.

In one embodiment, the composition is the fine chemical.

The fine chemical indicated in column 6 of application no. 10 in Table I, in particular vitamin E or its precursor 2,3-dimethyl-5-phytylquinol resp., e.g. alpha-, beta-, and/or gamma-tocopherol resp., and being obtained in the process of the invention are suitable as starting material for the synthesis of further products of value. For example, they can be used in combination with each other or alone for the production of pharmaceuticals, foodstuffs, animal feeds or cosmetics.

Accordingly, the present invention relates a method for the production of pharmaceuticals, food stuff, animal feeds, nutrients or cosmetics comprising the steps of the process according to the invention, including the isolation of a composition comprising the fine chemical, e.g. Vitamin E- or its precursor 2,3-dimethyl-5-phytylquinol, or the isolated respective fine chemical produced, if desired, and formulating the product with a pharmaceutical acceptable carrier or formulating the product in a form acceptable for an application in agriculture. A further embodiment according to the invention is the use of the respective fine chemical indicated in application no. 10, Table I, column 6, and being produced in the process or the use of the transgenic organisms in animal feeds, foodstuffs, medicines, food supplements, cosmetics or pharmaceuticals.

for the disclosure of the paragraphs [0366.0.0.9] to [0369.0.0.9] see paragraphs [0366.0.0.0] to [0369.0.0.0] above.

The fermentation broths obtained in this way, containing in particular the respective fine chemical indicated in column 6 of any one of Tables I to IV; application no. 10 or containing mixtures with other compounds, in particular with other vitamins or e.g. with carotenoids, e.g. with astaxanthin, or fatty acids or containing microorganisms or parts of microorganisms, like plastids, normally have a dry matter content of from 7.5 to 25% by weight. The fermentation broth can be processed further. Depending on requirements, the biomass can be separated, such as, for example, by centrifugation, filtration, decantation coagulation/flocculation or a combination of these methods, from the fermentation broth or left completely in it. The fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction, freeze-drying, spray drying, spray granulation or by other processes.

As vitamin E is often localized in membranes or plastids, in one embodiment it is advantageous to avoid a leaching of the cells when the biomass is isolated entirely or partly by separation methods, such as, for example, centrifugation, filtration, decantation, coagulation/flocculation or a combination of these methods, from the fermentation broth. The dry biomass can directly be added to animal feed, provided the vitamin E concentration is sufficiently high and no toxic compounds are present. In view of the instability of vitamin E, conditions for drying, e.g. spray or flash-drying, can be mild and can be avoiding oxidation and cis/trans isomerization. For example antioxidants, e.g. BHT, ethoxyquin or other, can be added. In case the vitamin E concentration in the biomass is to dilute, solvent extraction can be used for their isolation, e.g. with alcohols, ether or other organic solvents, e.g. with methanol, ethanol, aceton, alcoholic potassium hydroxide, glycerol-fenol, liquefied fenol or for example with acids or bases, like trichloroacetatic acid or potassium hydroxide. A wide range of advantageous methods and techniques for the isolation of vitamin E can be found in the state of the art.

Accordingly, it is possible to further purify the produced vitamin E or its precursor 2,3-dimethyl-5-phytylquinol resp., in particular, alpha-, beta-, and/or gamma-tocopherol, resp. For this purpose, the product-containing composition, e.g. a total or partial lipid extraction fraction using organic solvents, e.g. as described above, is subjected for example to a saponification to remove triglycerides, partition between e.g. hexane/methanol (separation of non-polar epiphase from more polar hypophasic derivates) and separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.9] to [0376.0.0.9], [0376.1.0.9] and [0377.0.0.9] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting, e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 10, columns 5 and 7, preferably in table IB, application no. 10, columns 5 and 7, and, optionally, isolating the full length cDNA clone or complete genomic clone;

(c) introducing the candidate nucleic acid molecules in host cells, preferably in a plant cell or a microorganism, appropriate for producing the respective fine chemical;

(d) expressing the identified nucleic acid molecules in the host cells;

(e) assaying the respective fine chemical level in the host cells; and (f) identifying the nucleic acid molecule and its gene product which expression confers an increase in the respective fine chemical level in the host cell after expression compared to the wild type.

for the disclosure of the paragraphs [0379.0.0.9] to [0383.0.0.9] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 10, column 3, e.g. comparing near identical organisms with low and high activity of the proteins as shown in table II, application no. 10, column 3.

for the disclosure of the paragraphs [0385.0.0.9] to [0404.0.0.9] see paragraphs [0385.0.0.0] to [0404.0.0.0] above.

Accordingly, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical indicated in Column 6, Table I, application no. 10 or for the production of the respective fine chemical and one or more other carotenoids, vitamins or fatty acids. In one embodiment, in the process of the present invention, the produced vitamin E is used to protect fatty acids against oxidization, e.g. it is in a further step added in a pure form or only partly isolated to a composition comprising fatty acids.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the respective fine chemical in a organism or part thereof, e.g. in a cell.

The nucleic acid molecule of the invention, the vector of the invention or the nucleic acid construct of the invention may also be useful for the production of organisms resistant to inhibitors of the vitamin E production biosynthesis pathways. In particular, the overexpression of the polypeptide of the present invention may protect an organism such as a microorganism or a plant against inhibitors, which block the vitamin E, in particular the respective fine chemical synthesis in said organism.

As vitamin E can protect organisms against damages of oxidative stress, especially singlet oxygens, a increased level of the respective fine chemical can protect plants against herbicides which cause the toxic buildup of oxidative compounds, e.g. singlet oxygens. For example, inhibition of the protoporphorineogen oxidase (Protox), an enzyme important in the synthesis of chlorophyll and heme biosynthesis results in the loss of chlorophyll and carotenoids and in leaky membranes; the membrane destruction is due to creation of free oxygen radicals (which is also reported for other classic photosynthetic inhibitor herbicides).

Accordingly, in one embodiment, the increase of the level of the respective fine chemical is used to protect plants against herbicides destroying membranes due to the creation of free oxygen radicals.

Examples of inhibitors or herbicides building up oxidative stress are aryl triazion, e.g. sulfentrazone, carfentrazone; or diphenylethers, e.g. acifluorfen, lactofen, or oxyfluorfen; or N-Phenylphthalimide, e.g. flumiclorac or flumioxazin; substituted ureas, e.g. fluometuron, tebuthiuron, diuron, or linuron; triazines, e.g. atrazine, prometryn, ametryn, metributzin, prometon, simazine, or hexazinone: or uracils, e.g. bromacil or terbacil.

In a further embodiment the present invention relates to the use of the antagonist of the present invention, the plant of the present invention or a part thereof, the microorganism or the host cell of the present invention or a part thereof for the production a cosmetic composition or a pharmaceutical composition. Such a composition has an antioxidative activity, photoprotective activity, can be used to protect, treat or heal the above mentioned diseases, e.g. rhypercholesterolemic or cardiovascular diseases, certain cancers, and cataract formation or as immunostimulatory agent.

The vitamin E can be also used as stabilizer of other colours or oxygen sensitive compounds, like fatty acids, in particular unsaturated fatty acids.

for the disclosure of the paragraphs [0406.0.0.9] to [0416.0.0.9] see paragraphs [0406.0.0.0] to [0416.0.0.0] above.

An in vivo mutagenesis of organisms such as algae (e.g. *Spongiococcum* sp, e.g. *Spongiococcum exentricum*, *Chlorella* sp., *Haematococcus*, *Phaedactylum tricornatum*, *Volvox* or *Dunaliella*), *Synechocystis* sp. PCC 6803, *Physcometrella patens*, *Saccharomyces*, *Mortierella*, *Escherichia* and others mentioned above, which are beneficial for the production of vitamin E can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromo-uracil, N-methyl-N-nitro-N-nitrosoguanidine (=NTG), ethyl methanesulfonate (=EMS), hydroxylamine and/or nitrous acid are widely used as chemical agents for random in-vitro mutagensis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired fine chemical.

for the disclosure of the paragraphs [0418.0.0.9] to [0427.0.0.9] see paragraphs [0418.0.0.0] to [0427.0.0.0] above.

*Synechocystis* sp. PCC 6803 is a unicellular, non-nitrogen-fixing cyanobacterium which has undergone thorough genetic investigation (Churin et al. (1995) J Bacteriol 177: 3337-3343), can easily be transformed (Williams (1988)

Methods Enzymol 167:766-778) and has a very active homologous recombination potential. The strain PCC 6803 was isolated as Aphanocapsa N-1 from fresh water in California, USA, by R. Kunisawa in 1968 and is now obtainable through the "Pasteur Culture Collection of Axenic Cyanobacterial Strains" (PCC), Unité de Physiologie Microbienne, Paris, France. The complete genomic sequence of *Synechocystis* sp. PCC 6803 has been published from 1995 (Kaneko et al. (1995) DNA Research 2:153-166; Kaneko et a. (1995) DNA Research 2:191-198; Kaneko et a. (1996) DNA Research 3:109-136; Kaneko et a. (1996) DNA Research 3:185-209; Kaneko and Tabata (1997) Plant Cell Physiol 38:1171-1176; Kotani and Tabata (1998) Annu Rev Plant Physiol 49:151-171) and is published on the Internet (http://www.kazusa.or.jp/cyano/cyano.html) under the name "CyanoBase". Efficient expression systems for *Synechocystis* 6803 are described in the literature (Mermet-Bouvier et al. (1993) Curr Microbiol 27:323-327; Mermet-Bouvier and Chauvat (1993) Curr Microbiol 28:145-148; Murphy and Stevens (1992) Appl Environ Microbiol 58:1650-1655; Takeshima et al. (1994) Proc Natl Acad Sci USA 91:9685-9689; Xiaoqiang et al. (1997) Appl Environ Microbiol 63:4971-4975; Ren et al. (1998) FEMS Microbiol Lett 158: 127-132).

Growing *Synechocystis*

The cells of *Synechocystis* sp. PCC 6803 can be normally cultured autotrophically in BG11 medium. They have a diameter of 2.3 to 2.5 µm. For example, a cyanobacterium *Synechocystis* sp. PCC 6803 strain which is glucose-tolerant can be used, i.e. it is also able to grow heterotrophically in the dark with only a few minutes of weak blue light illumination per day. The culture conditions were developed by Anderson and McIntosh (Anderson und McIntosh (1991) J Bacteriol 173: 2761-2767) and called light-activated heterotrophic growth (LAHG). This makes it possible to cultivate these cyanobacteria without continuous photosynthesis and thus without production of oxygen.

| BG 11 culture medium for *Synechocystis* Stock solution 100 × BG11: | |
|---|---|
| NaNO$_3$ | 1.76 M = 149.58 g |
| MgSO$_4$ × 7 H$_2$O | 30.4 mM = 7.49 g |
| CaCl$_2$ × 2 H$_2$O | 24.5 mM = 3.6 g |
| Citric acid | 3.12 mM = 0.6 g |
| Na EDTA pH 8 | 0.279 mM = 0.104 g |

The weighed substances can be dissolved in 900 ml of H2O and made up to 1000 ml with 100 ml of the trace metal mix stock 1000×. The solution thus obtained is used as stock solution.

| Trace metal mix stock 1000×: | |
|---|---|
| H$_3$BO$_3$ | 46.3 mM = 2.86 g/l |
| MnCl$_2$ × 4 H$_2$O | 4.15 mM = 1.81 g/l |
| ZnSO$_4$ × 7 H$_2$O | 0.77 mM = 0.222 g/l |
| Na$_2$MoO$_4$ × 2 H$_2$O | 1.61 mM = 0.39 g/l |
| CuSO$_4$ × 5 H$_2$O | 0.32 mM = 0.079 g/l |
| Co(NO$_3$)$_2$ × 6 H$_2$O | 0.17 mM = 0.0494 g/l |

The following solutions are required for 1 liter of BG11 culture solution:
1. 10 ml of stock solution 100×BG 11
2. 1 ml Na$_2$CO$_3$ (189 mM)
3. 5 ml TES (1 M, pH8)
4. 1 ml K$_2$PO$_4$ (175 mM)

Whereas solution 2. and 3. ought to be sterilized by filtration, solution 4 must be autoclaved. The complete BG11 culture solution must be autoclaved before use and then be mixed with 1 ml of iron ammonium citrate (6 mg/ml) which has previously been sterilized by filtration. The iron ammonium citrate should never be autoclaved. For agar plates, 1.5% (w/v) bacto agar are added per liter of BG11 medium.

Amplification and cloning of DNA from *Synechocystis* spec. PCC 6803 The DNA can be amplified by the polymerase chain reaction (PCR) from *Synechocystis* spec. PCC 6803 by the method of Crispin A. Howitt (Howitt Calif. (1996) BioTechniques 21:32-34).

Tocopherol production in *Synechocystis* spec. PCC 6803 The cells of each of independent *Synechocystis* spec. PCC 6803 strains cultured on the BG-11 km agar medium, and untransformed wild-type cells (on BG11 agar medium without kanamycin) can be used to inoculate liquid cultures. For this, cells of a mutant or of the wild-type *Synechocystis* spec. PCC 6803 are transferred from plate into 10 ml of liquid culture in each case. These cultures are cultivated at 28° C. and 30 µmol photons*(m$^2$*s)$^{-1}$ (30 µE) for about 3 days. After determination of the OD$_{730}$ of the individual cultures, the OD$_{730}$ of all cultures is synchronized by appropriate dilutions with BG-11 (wild types) or e.g. BG-11 km (mutants). These cell density-synchronized cultures are used to inoculate three cultures of the mutant and of the wild-type control. It is thus possible to carry out biochemical analyses using in each case three independently grown cultures of a mutant and of the corresponding wild types. The cultures are grown until the optical density was OD$_{730}$=0.3.

The cell culture medium is removed by centrifugation in an Eppendorf bench centrifuge at 14000 rpm twice. The subsequent disruption of the cells and extraction of the tocopherols or vitamin E take place by incubation in an Eppendorf shaker at 30° C., 1000 rpm in 100% methanol for 15 minutes twice, combining the supernatants obtained in each case.

In order to avoid oxidation, the resulting extracts can be analyzed immediate after the extraction with the aid of a Waters Allience 2690 HPLC system. Tocopherols and vitamin E is separated on a reverse phase column (ProntoSil 200-3-C30, Bischoff) with a mobile phase of 100% methanol, and identified by means of a standard (Merck). The fluorescence of the substances (excitation 295 nm, emission 320 nm), which is detected with the aid of a Jasco FP 920 fluorescence detector, can serve as detection system.

for the disclosure of the paragraphs [0428.0.0.9] to [0435.0.0.9] see paragraphs [0428.0.0.0] to [0435.0.0.0] above.

Vitamin E Production

Vitamin E, like alpha-, beta-, or gamma-tocopherol, or its precursor 2,3-dimethyl-5phytylquinol, can be detected advantageously as described in Deli, J. & Molnar, P., Paprika carotenoids: Analysis, isolation, structure elucidation. Curr. Org. Chem. 6, 1197-1219 (2004) or Fraser, P. D., Pinto, M. E., Holloway, D. E. & Bramley, P. M. Technical advance: application of high-performance liquid chromatography with photodiode array detection to the metabolic profiling of plant isoprenoids. Plant J. 24, 551-558 (2000).

for the disclosure of the paragraphs [0437.0.0.9] and [0438.0.0.9] see paragraphs [0437.0.0.0] and [0438.0.0.0] above.

Example 8

Analysis of the Effect of the Nucleic Acid Molecule on the Production of the Respective Fine Chemical Indicated in Table I, Application No. 10, Column 6

The effect of the genetic modification in plants, fungi, algae or ciliates on the production of a desired compound can be determined by growing the modified microorganisms or the modified plant under suitable conditions (such as those described above) and analyzing the medium and/or the cellular components for the elevated production of desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p.1-27, VCH: Weinheim; and Dechow, F. J. (1989) Separation and purification techniques in biotechnology, Noyes Publications).

Vitamin E, like alpha-, beta-, or gamma-tocopherol, or its precursor 2,3-dimethyl-5-phytylquinol, can be detected advantageously as described in Deli, J. & Molnar, P., Paprika carotenoids: Analysis, isolation, structure elucidation. Curr. Org. Chem. 6, 1197-1219 (2004) or Fraser, P. D., Pinto, M. E., Holloway, D. E. & Bramley, P. M. Technical advance: application of high-performance liquid chromatography with photodiode array detection to the metabolic profiling of plant isoprenoids. Plant J. 24, 551-558 (2000).

for the disclosure of this paragraph see [0441.0.0.0] above.

Example 9

Purification of the Vitamin E or its Precursor 2,3-dimethyl-5-phytyiquinol

Abbreviations: GC-MS, gas liquid chromatography/mass spectrometry; TLC, thin-layer chromatography.

The unambiguous detection for the presence of vitamin E, like alpha-, beta-, or gamma-tocopherol, or its precursor 2,3-dimethyl-5-phytylquinol can be obtained by analyzing recombinant organisms using analytical standard methods: GC, GC-MS or TLC, as described (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). The total vitamin E produced in the organism for example in yeasts used in the inventive process can be analysed for example according to the following procedure: The material such as yeasts, E. coli or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, seperation of non-polar epiphase from more polar hypophasic derivatives and chromatography.

Characterization of the Transgenic Plants

In order to confirm that vitamin E biosynthesis in the transgenic plants is influenced by the expression of the polypeptides described herein, the tocopherol/vitamin E content in leaves and seeds of the plants transformed with the described constructs (*Arabidopsis.thaliana, Brassica napus* and *Nicotiana tabacum*) is analyzed. For this purpose, the transgenic plants are grown in a greenhouse, and plants which express the gene coding for polypeptide of the invention or used in the method of the invention are identified at the Northern level. The tocopherol content or the vitamin E content in leaves and seeds of these plants is measured. In all, the tocopherol concentration is raised by comparison with untransformed plants.

If required and desired, further chromatography steps with a suitable resin may follow. Advantageously, the vitamin E, like alpha-, beta-, or gamma-tocopherol, or its precursor 2,3-dimethyl-5-phytylquinol, can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

for the disclosure of the paragraphs [0446.0.0.9] to [0496.0.0.9] see paragraphs [0446.0.0.0] to [0496.0.0.0] above.

As an alternative, the vitamin E, like alpha-, beta-, or gamma-tocopherol, or its precursor 2,3-dimethyl-5-phytylquinol, can be detected advantageously as described in Deli, J. & Molnar, P., Paprika carotenoids: Analysis, isolation, structure elucidation. Curr. Org. Chem. 6, 1197-1219 (2004) or Fraser, P. D., Pinto, M. E., Holloway, D. E. & Bramley, P. M. Technical advance: application of high-performance liquid chromatography with photodiode array detection to the metabolic profiling of plant isoprenoids. Plant J. 24, 551-558 (2000).

The results of the different plant analyses can be seen from the table, which follows:

TABLE VI

| ORF | Metabolite | Method/Analytics | Min.-Value | Max.-Value |
| --- | --- | --- | --- | --- |
| b1251 | alpha-Tocopherol | LC | 1.35 | 1.81 |
| b1704 | alpha-Tocopherol | LC | 1.25 | 1.82 |
| b2600 | alpha-Tocopherol | GC | 1.53 | 1.88 |
| b2601 | alpha-Tocopherol | LC | 1.56 | 7.11 |
| b2965 | alpha-Tocopherol | GC | 1.72 | 3.04 |
| b3390 | alpha-Tocopherol | GC | 1.62 | 1.68 |
| b2600 | alpha-Tocotrienol | LC | 1.68 | 16.12 |
| b1704 | gamma-Tocopherol/beta-Tocopherol/2,3-Dimethyl-5-phytylquinol | LC | 1.83 | 16.47 |
| b2600 | gamma-Tocopherol/beta-Tocopherol/2,3-Dimethyl-5-phytylquinol | LC | 2.40 | 5.64 |
| b2601 | gamma-Tocopherol/beta-Tocopherol/2,3-Dimethyl-5-phytylquinol | LC | 1.63 | 3.57 |
| b2965 | gamma-Tocopherol/beta-Tocopherol/2,3-Dimethyl-5-phytylquinol | LC | 3.03 | 7.10 |
| b3281 | gamma-Tocopherol/beta-Tocopherol/2,3-Dimethyl-5-phytylquinol | LC | 1.38 | 2.64 |
| b3390 | gamma-Tocopherol/beta- | LC | 1.41 | 1.86 |

TABLE VI-continued

| ORF | Metabolite | Method/Analytics | Min.-Value | Max.-Value |
|---|---|---|---|---|
| b2600 | Tocopherol/2,3-Dimethyl-5-phytylquinol gamma-Tocotrienol/beta-Tocotrienol | LC | 7.77 | 16.43 |

In the context of this table "gamma-Tocopherol/beta-Tocopherol/2,3-Dimethyl-5-phytylquinol" means the total amount of gamma-Tocopherol and beta-Tocopherol and 2,3-Dimethyl-5-phytylquinol.

for the disclosure of the paragraphs [0499.0.0.9] and [0500.0.0.9] see paragraphs [0499.0.0.0] and [0500.0.0.0] above.

Example 15a

Engineering Ryegrass Plants by Over-Expressing b1251 from *E. coli* or Homologs of b1251 from Other Organisms for the disclosure of the paragraphs [0502.0.0.9] to [0508.0.0.9] see paragraphs [0502.0.0.0] to [0508.0.0.0] above.

Example 15b

Engineering Soybean Plants by Over-expressing b1251 from *E. coli* or Homologs of b1251 from Other Organisms for the disclosure of the paragraphs [0510.0.0.9] to [0513.0.0.9] see paragraphs [0510.0.0.0] to [0513.0.0.0] above.

Example 15c

Engineering Corn Plants by Over-Expressing b1251 from *E. coli* or Homologs of b1251 from Other Organisms for the disclosure of the paragraphs [0515.0.0.9] to [0540.0.0.9] see paragraphs [0515.0.0.0] to [0540.0.0.0] above.

Example 15d

Engineering Wheat Plants by Over-Expressing b1251 from *E. coli* or Homologs of b1251 from Other Organisms for the disclosure of the paragraphs [0542.0.0.9] to [0544.0.0.9] see paragraphs [0542.0.0.0] to [0544.0.0.0] above.

Example 15e

Engineering Rapeseed/Canola Plants by Over-Expressing b1251 from *E. coli* or Homologs of b1251 from Other Organisms for the disclosure of the paragraphs [0546.0.0.9] to [0549.0.0.9] see paragraphs [0544.0.0.0] to [0549.0.0.0] above.

Example 15f

Engineering Alfalfa Plants by Over-Expressing b1251 from *E. coli* or Homologs of b1251 from Other Organisms for the disclosure of the paragraphs [0551.0.0.9] to [0554.0.0.9] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII as minimal (MIN) or maximal changes (MAX) in the respective fine chemical (column "metabolite") in genetically modified corn plants expressing the sequence listed in column 1 (ORF):

TABLE VII

| ORF | Metabolite | MIN | MAX |
|---|---|---|---|
| b2601 | alpha-Tocopherol | 1.56 | 2.67 |
| b2601 | beta/gamma-Tocopherol | 1.74 | 4.90 |
| b3390 | beta/gamma-Tocopherol | 1.83 | 2.03 |
| b3390 | alpha-Tocopherol | 1.47 | 1.86 |

In the context of this table "beta/gamma-Tocopherol" means the total amount of gamma-Tocopherol and beta-Tocopherol, In one embodiment, in case the activity of the protein listed in column 1 of Table VII or its homologs, is increased in corn plants, preferably, an increase of the respective fine chemical as indicated in column 2 (Metabolite) is in the range between the minimal value shown in the line "MIN" and the maximal value shown in the line "MAX is conferred.

for the disclosure of this paragraph see [0554.2.0.0] above.
for the disclosure of this paragraph see [0555.0.0.0] above.
for the disclosure of this paragraph see [0001.0.0.0].

Carotenoids are red, yellow and orange pigments that are widely distributed in nature. Although specific carotenoids have been identified in photosynthetic centers in plants, in bird feathers, in crustaceans and in marigold petals, they are especially abundant in yellow-orange fruits and vegetables and dark green, leafy vegetables. Of the more than 700 naturally occurring carotenoids identified thus far, as many as 50 may be absorbed and metabolized by the human body. To date, only 14 carotenoids have been identified in human serum.

In animals some carotenoids (particularly beta-carotene) serve as dietary precursors to Vitamin A, and many of them may function as fat-soluble antioxidants. In plants carotenes serve for example as antioxidants to protect the highly reactive photosystems and act as accessory photopigments. In vitro experiments have shown that lycopene, alpha-carotene, zeaxanthin, lutein and cryptoxanthin quench singlet oxygen and inhibit lipid peroxidation. The isolation and identification of oxidized metabolites of lutein, zeaxanthin and lycopene provide direct evidence of the antioxidant action of these carotenoids.

Carotenoids are 40-carbon ($C_{40}$) terpenoids generally comprising eight isoprene ($C_5$) units joined together. Linking of the units is reversed at the center of the molecule. "Keto-carotenoid" is a general term for carotenoid pigments that contain a keto group in the ionene ring portion of the molecule, whereas "hydroxycarotenoid" refers to carotenoid pigments that contain a hydroxyl group in the ionene ring. Trivial names and abbreviations will be used throughout this disclosure, with IUPAC-recommended semisystematic names usually being given in parentheses after first mention of a trivial name.

Carotenoids are synthesized from a five carbon atom metabolic precursor, isopentenyl pyrophosphate (IPP). There are at least two known biosynthetic pathways in the formation of IPP, the universal isoprene unit. One pathway begins with mevalonic acid, the first specific precursor of terpenoids, formed from acetyl-CoA via HMG-CoA (3hydroxy-3-methylglutaryl-CoA), that is itself converted to isopentenyl pyrophosphate (IPP). Later, condensation of two geranylgeranyl pyrophosphate (GGPP) molecules with each other produces colorless phytoene, which is the initial carotenoid. Studies have also shown the existence of an alternative, mevalonate-independent pathway for IPP formation that was characterized initially in several species of eubacteria, a green alga, and in the plastids of higher plants. The first reaction in this alternative pathway is the transketolase-type condensation reaction of pyruvate and D-glyceraldehyide-3-phosphate to yield 1-deoxy-D-xylulose-5-phosphate (DXP) as an intermediate.

Through a series of desaturation reactions, phytoene is converted to phytofluene, ζ-carotene, neurosporene and finally to lycopene. Subsequently, lycopene is converted by a cyclization reaction to β-carotene that contains two β-ionene rings. A keto-group and/or a hydroxyl group are introduced into each ring of β-carotene to thereby synthesize canthaxanthin, zeaxanthin, astaxanthin. A hydroxylase enzyme has been shown to convert canthaxanthin to astaxanthin. Similarly, a ketolase enzyme has been shown to convert zeaxanthin to astaxanthin. The ketolase also converts β-carotene to canthaxanthin and the hydroxylase converts β-carotene to zeaxanthin.

Carotenoids absorb light in the 400-500 nm region of the visible spectrum. This physical property imparts the characteristic red/yellow color of the pigments. A conjugated backbone composed of isoprene units is usually inverted at the center of the molecule, imparting symmetry. Changes in geometrical configuration about the double bonds result in the existence of many cis- and trans-isomers. Hydroxylated, oxidized, hydrogenated or ring-containing derivatives also exist. Hydrocarbon carotenoids are classified as carotenes while those containing oxygen are known as xanthophylls.

In animals, carotenoids are absorbed from the intestine with the aid of dietary fat and incorporated into chylomicrons for transport in the serum. The different structural features possessed by carotenoids account for selective distribution in organ tissue, biological activity and pro-vitamin A potency, or in vivo conversion to vitamin A. Due to the hydrophobic character, carotenoids are associated with lipid portions of human tissues, cells, and membranes. In general, 80-85% of carotenoids are distributed in adipose tissue, with smaller amounts found in the liver, muscle, adrenal glands, and reproductive organs. Approximately 1% circulate in the serum on high and low density lipoproteins. Serum concentrations are fairly constant and slow to change during periods of low intake. The estimated half-life was estimated to be 11-14 days for lycopene, α-carotene, β-carotene, lutein and zeaxanthin. Evidence for the existence of more than one body pool has been published. The major serum carotenoids are α-carotene, β-carotene, lutein, zeaxanthin, lycopene and cryptoxanthin. Smaller amounts of polyenes such as phytoene and phytofluene are also present.

Human serum levels reflect lifestyle choices and dietary habits within and between cultures. Approximately only 15 circulate in the blood, on HDL and LDL. Variations can be attributed to different intakes, unequal abilities to absorb certain carotenoids, and different rates of metabolism and tissue uptake. Decreased serum levels occur with alcohol consumption, the use of oral contraceptives, smoking and prolonged exposure to UV light.

α-Carotene, β-carotene and β-cryptoxanthin can be converted to retinol or vitamin A in the intestine and liver by the enzyme 15-15'-b-carotenoid dioxygenase. Such in vivo formation of retinol appears to be homeostatically controlled, such that conversion to retinol is limited in persons having adequate vitamin A status.

The established efficacy of beta-carotene in quenching singlet oxygen and intercepting deleterious free radicals and reactive oxygen species makes it part of the diverse antioxidant defense system in humans. Reactive oxygen species have been implicated in the development of many diseases, including ischemic heart disease, various cancers, cataracts and macular degeneration. Because the conjugated polyene portion of beta-carotene confers its antioxidant capability and all carotenoids possess this structural feature, research efforts have been directed at evaluating the efficacy of other carotenoids in the prevention of free radical-mediated diseases. Indeed, in vitro experiments have demonstrated that lycopene, alpha-carotene, zeaxanthin, lutein and cryptoxanthin quench singlet oxygen and inhibit lipid peroxidation. The isolation and identification of oxidized metabolites of lutein, zeaxanthin and lycopene may provide direct evidence of the antioxidant action of these carotenoids.

In addition to antioxidant capability, other biological actions of carotenoids include the ability to enhance immunocompetence and in vitro gap junction communication, reduce or inhibited mutagenesis and inhibit cell transformations in vitro.

Many epidemiological studies have established an inverse correlation between dietary intake of yellow-orange fruit and dark green, leafy vegetables and the incidence of various cancers, especially those of the mouth, pharynx, larynx, esophagus, lung, stomach, cervix and bladder. While a number of protective compounds may be responsible for this observation, the co-incidence of carotenoids in these foods has been noted. Because nutritionists and medical professionals currently recognize the occurrence of a large number of distinct carotenoids in food, interest in their functions and biological impact on health is burgeoning.

Lutein exists in the retina. It functions to protect photoreceptor cells from lightgenerated oxygen radicals, and thus plays a key role in preventing advanced macular degeneration. Lutein possesses chemopreventive activity, induces gap junction communication between cells and inhibits lipid peroxidation in vitro more effectively than beta-carotene, alpha-carotene and lycopene. High levels of lutein in serum have been inversely correlated with lung cancer.

In addition to lutein, zeaxanthin exists in the retina and confers protection against macular degeneration. Zeaxanthin is also prevalent in ovaries and adipocyte tissue. This xanthophyll does not possess provitamin A activity.

Alcohol consumption has been shown to influence lipid peroxidation. Anhydrolutein, an oxidative by-product of lutein and zeaxanthin, was higher in plasma after alcohol ingestion, while concentrations of these xanthophylls were reduced. Lutein and zeaxanthin may therefore have protective effects against LDL oxidation.

The all-trans isomer of Lycopene is typically quantified in serum, although signals for 9-, 13- and 15-cis isomers are detectable and account for as much as 50% of the total lycopene. In experiments performed in vitro, lycopene quenched singlet oxygen more efficiently than alpha-carotene, beta-carotene, zeaxanthin, lutein and cryptoxanthin. Lycopene induces gap junction communication, inhibits lipid peroxidation and has displays chemopreventive activity. Serum levels of lycopene have been inversely related to the risk of cancer in the pancreas and cervix. This carotenoid has been identified in tissues of the thyroid, kidneys, adrenals, spleen, liver, heart, testes and pancreas. Lycopene is not converted to retinol in vivo.

beta-Cryptoxanthin is capable of quenching singlet oxygen. beta-Cryptoxanthin is used to color butter. beta-Cryptoxanthin exhibits provitamin A activity.

The all-trans isomer of this carotenoid is the major source of dietary retinoids, due to its high provitamin A activity. One molecule of trans-beta-carotene can theoretically provide two molecules of trans retinaldehyde in vivo. Signals for 13- and 15-cis isomers of beta-carotene are also observed in the carotenoid profile and account for 10% or less of the total beta-carotene in serum. beta-Carotene quenches singlet oxygen, induces gap junction communication and inhibits lipid peroxidation. High serum levels of betacarotene are correlated with low incidences of cancer in the mouth, lung, breast, cervix, skin and stomach. beta-Carotene has been identified in tissues of the thyroid, kidney, spleen, liver, heart, pancreas, fat, ovaries and adrenal glands.

alpha-Carotene is similar to beta-carotene in its biological activity, but quenches singlet oxygen more effectively. alpha-Carotene improves gap junction communication, prevents lipid peroxidation and inhibits the formation and uptake of carcinogens in the body. High serum levels have been associated with lower risks of lung cancer. With one half the provitamin A potency of beta-carotene, alpha-carotene also restores normal cell growth and differentiation. Serum levels are usually between 10 and 20% of the values for total beta-carotene.

Alpha-Carotene, beta-carotene and beta-cryptoxanthin can be converted to Vitamin A in the intestine and liver. Vitamin A is essential for the immune response and is also involved in other defenses against infectious agents. Nevertheless, in many individuals, this conversion is slow and ineffectual, particularly for older. Some individuals are known as non or low-responders because they do not convert beta-carotene to Vitamin A at the rate as expected. A number of factors can inhibit this conversion of betacarotene to Vitamin A. The major reason why so many Americans have a poor vitamin A status is the regular use of excessive alcohol. Intestinal parasites can be a factor. And, any prescription drug that requires liver metabolism will decrease the liver conversion of beta-carotene to retinol in the liver. Diabetics and individuals with hypothyroidism or even borderline hypothyroidism are likely to be low-responders.

In plants, approximately 80-90% of the carotenoids present in green, leafy vegetables such as broccoli, kale, spinach and brussel sprouts are xanthophylls, whereas 10-20% are carotenes. Conversely, yellow and orange vegetables including carrots, sweet potatoes and squash contain predominantly carotenes. Up to 60% of the xanthophylls and 15% of the carotenes in these foods are destroyed during microwave cooking. Of the xanthophylls, lutein appears to be the most stable.

Lutein occurs in mango, papaya, oranges, kiwi, peaches, squash, peas, lima beans, green beans, broccoli, brussel sprouts, cabbage, kale, lettuce, prunes, pumpkin, sweet potatoes and honeydew melon. Commercial sources are obtained from the extraction of marigold petals. Lutein does not possess provitamin A activity.

Dietary sources of Zeaxanthin include peaches, squash, apricots, oranges, papaya, prunes, pumpkin, mango, kale, kiwi, lettuce, honeydew melon and yellow corn.

The red color of fruits and vegetables such as tomatoes, pink grapefruit, the skin of red grapes, watermelon and red guavas is due to lycopene. Other dietary sources include papaya and apricots.

beta-Cryptoxanthin occurs in oranges, mango, papaya, cantaloupe, peaches, prunes, squash.

Dietary sources of beta-Carotene include mango, cantaloupe, carrots, pumpkin, papaya, peaches, prunes, squash, sweet potato, apricots, cabbage, lima beans, green beans, broccoli, brussel sprouts, kale, kiwi, lettuce, peas, spinach, tomatoes, pink grapefruit, honeydew melon and oranges.

Dietary sources of alpha-Carotene include sweet potatoes, apricots, pumpkin, cantaloupe, green beans, lima beans, broccoli, brussel sprouts, cabbage, kale, kiwi, lettuce, peas, spinach, prunes, peaches, mango, papaya, squash and carrots.

Some carotenoids occur particularly in a wide variety of marine animals including fish such as salmonids and sea bream, and crustaceans such as crab, lobster, and shrimp. Because animals generally cannot biosynthesize carotenoids, they obtain those carotenoids present in microorganisms or plants upon which they feed. Carotenoids e.g. xanthophylls, e.g. as astaxanthin, supplied from biological sources, such as crustaceans, yeast, and green alga is limited by low yield and costly extraction methods when compared with that obtained by organic synthetic methods. Usual synthetic methods, however, produce by-products that can be considered unacceptable. It is therefore desirable to find a relatively inexpensive source of carotenoids, in particular xanthophylls, to be used as a feed supplement in aquaculture and as a valuable chemical for other industrial uses and for diets. Sources of Xanthophylls include crustaceans such as a krill in the Antarctic Ocean, cultured products of the yeast *Phaffia*, cultured products of a green alga *Haematococcus pluvialis*, and products obtained by organic synthetic methods. However, when crustaceans such as a krill or the like are used, a great deal of work and expense are required for the isolation of xanthophylls from contaminants such as lipids and the like during the harvesting and extraction. Moreover, in the case of the cultured product of the yeast *Phaffia*, a great deal of expense is required for the gathering and extraction of astaxanthin because the yeast has rigid cell walls and produces xanthophylls only in a low yield. One approach to increase the productivity of some xanthophylls' production in a biological system is to use genetic engineering technology.

In many plants, lycopene is a branch point in carotenoid biosynthesis. Thus, some of the plant's lycopene is made into beta-carotene and zeaxanthin, and sometimes zeaxanthin diglucoside, whereas remaining portions of lycopene are formed into alpha-carotene and lutein (3,3'-dihydroxy-$\alpha$-carotene), another hydroxylated compound. Carotenoids in higher plants; i.e., angiosperms, are found in plastids; i.e., chloroplasts and chromoplasts. Plastids are intracellular storage bodies that differ from vacuoles in being surrounded by a double membrane rather than a single membrane. Plastids such as chloroplasts can also contain their own DNA and ribosomes, can reproduce independently and synthesize some of their own proteins. Plastids thus share several characteristics of mitochondria. In leaves, carotenoids are usually present in the grana of chloroplasts where they provide a photoprotective function. Beta-carotene and lutein are the predominant carotenoids, with the epoxidized carotenoids violaxanthin and neoxanthin being present in smaller amounts. Carotenoids accumulate in developing chromoplasts of flower petals, usually with the disappearance of chlorophyll. As in flower petals, carotenoids appear in fruit chromoplasts as they develop from chloroplasts. Most enzymes that take part in conversion of phytoene to carotenes and xanthophylls are labile, membrane-associated proteins that lose activity upon solubilization. In maize, cartonoids were present in horny endosperm (74% to 86%), floury endosperm (9%-23%) and in the germ and bran of the kernel.

At the present time only a few plants are widely used for commercial colored carotenoid production. However, the productivity of colored carotenoid synthesis in most of these plants is relatively low and the resulting carotenoids are expensively produced.

Dried marigold petals and marigold petal concentrates obtained from so-called xanthophyll marigolds are used as feed additives in the poultry industry to intensify the yellow color of egg yolks and broiler skin. The pigmenting ability of marigold petal meal resides largely in the carotenoid fraction known as the xanthophylls, primarily lutein esters. The xanthophyll zeaxanthin, also found in marigold petals, has been shown to be effective as a broiler pigmenter, producing a highly acceptable yellow to yellow-orange color. Of the xanthophylls, the pigments lutein and zeaxanthin are the most abundant in commercially available hybrids. Structural formulas for lutein and zeaxanthin are shown below.

Carotenoids have been found in various higher plants in storage organs and in flower petals. For example, marigold flower petals accumulate large quantities of esterified lutein as their predominant xanthophyll carotenoid (about 75 to more than 90 percent), with smaller amounts of esterified zeaxanthin. Besides lutein and zeaxanthin, marigold flower petals also typically exhibit a small accumulation of β-carotene and epoxidized xanthophylls, but do not produce or accumulate canthaxanthin or astaxanthin because a 4-keto-β-ionene ring-forming enzyme is absent in naturally-occurring marigolds or their hybrids.

One way to increase the productive capacity of biosynthesis is to apply recombinant DNA technology. Thus, it would be desirable to produce colored carotenoids generally and, with the use of recent advances in determining carotenoid biosynthesis from β-carotene to xanthophylls to control the production of carotenoids. That type of production permits control over quality, quantity and selection of the most suitable and efficient producer organisms. The latter is especially important for commercial production economics and therefore availability to consumers.

Methods of recombinant DNA technology have been used for some years to improve the production of Xanthophylls in microorganisms, in particular algae or in plants by amplifying individual xanthophyll biosynthesis genes and investigating the effect on xanthophyll production. It is for example reportet, that the five ketocarotenoids, e.g. the xanthophyll astaxanthin could be produced in the nectaries of transgenic tobacco plants. Those transgenic plants were prepared by *Argobacterium tumifaciens*-mediated transformation of tobacco plants using a vector that contained a ketolase-encoding gene from *H. pluvialis* denominated crtO along with the Pds gene from tomato as the promoter and to encode a leader sequence. The Pds gene was said by those workers to direct transcription and expression in chloroplasts and/or chromoplast-containing tissues of plants. Those results indicated that about 75 percent of the carotenoids found in the flower of the transformed plant contained a keto group. Further, in maize the phytonene synthase (Psy), Phytone desaturase (Pds), and the ζ-carotene desaturase were identified and it was shown, that PSY activity is an important control point for the regulation of the flux.

Genes suitable for conversion of microorganisms have also been reported (U.S. Pat. No. 6,150,130 WO 99/61652). Two different genes that can convert a carotenoid β-ionene ring compound into astaxanthin have been isolated from the green alga *Haematococcus pluvialis*. Zeaxanthin or ζ-carotene were also found in the marine bacteria *Agrobacterium aurantiacum, Alcaligenes* PC-1, *Erwinia uredovora*. An *A. aurantiacum* crtZ gene was introduced to an *E. coli* transformant that accumulated all-trans-β-carotene. The transformant so formed produced zeaxanthin. A gene cluster encoding the enzymes for a carotenoid biosynthesis pathway has been also cloned from the purple photosynthetic bacterium *Rhodobacter capsulatus*. A similar cluster for carotenoid biosynthesis from ubiquitous precursors such as farnesyl pyrophosphate and geranyl pyrophosphate has been cloned from the non-photosynthetic bacteria *Erwinia herbicola*. Yet another carotenoid biosynthesis gene cluster has been cloned from *Erwinia uredovora*. It is yet unknown and unpredictable as to whether enzymes encoded by other organisms behave similarly to that of *A. aurantiacum* in vitro or in vivo after transformation into the cells of a higher plant.

In addition to the above said about the biological importance of carotenoids, e.g. in vision, bone growth, reproduction, immune function, gene expression, emboryonic expression, cell division and cell differation, and respiration, it should be mentioned that in the world, the prevalence of vitamin A deficiency ranges from 100 to 250 million children and an estimated 250.000 to 500.000 children go blind each year from vitamin A deficiency.

Thus, it would be advantageous if an algae or other microorganism were available who produce large amounts of β-carotene, beta-cryptoxanthin, lutein, zeaxanthin, or other carotenoids. It might be advantageous that only small amounts or no lutein is produced so that such organisms could be transformed with e.g. one or more of an appropriate hydroxylase gene and/or an appropriate ketolase gene to produce cryptoxanthin, zeaxanthin or astaxanthin. The invention discussed hereinafter relates in some embodiments to such transformed prokaryotic or eukaryotic microorganisms.

It would also be advantageous if a marigold or other plants were available whose flowers produced large amounts of β-carotene, beta-cryptoxanthin, lutein, zeaxanthin, or other carotenoids. It might be advantageous that only small amounts or no lutein is produced so that such plants could be transformed with one or more of an appropriate hydroxylase gene and an appropriate ketolase gene to produce cryptoxanthin, zeaxanthin or astaxanthin from e.g. the flowers of the resulting transformants. The invention discussed hereinafter relates in some embodiments to such transformed plants.

Therefore improving the quality of foodstuffs and animal feeds is an important task of the food-and-feed industry. This is necessary since, for example, as mentioned above xanthophylls, which occur in plants and some microorganisms are limited with regard to the supply of mammals. Especially advantageous for the quality of foodstuffs and animal feeds is as balanced as possible a carotenoids profile in the diet since a great excess of some carotenoids above a specific concentration in the food has only some positive effect. A further increase in quality is only possible via addition of further carotenoids, which are limiting.

To ensure a high quality of foods and animal feeds, it is therefore necessary to add one or a plurality of carotenoids in a balanced manner to suit the organism.

Accordingly, there is still a great demand for new and more suitable genes which encode enzymes which participate in the biosynthesis of carotenoids, e.g. xanthophylls, e.g. like beta-crypotxanthin, or zeaxanthin, or astaxanthin, and make it possible to produce them specifically on an industrial scale without unwanted byproducts forming. In the selection of genes for biosynthesis two characteristics above all are particularly important. On the one hand, there is as ever a need for improved processes for obtaining the highest possible contents of carotenoids like xanthophylls; on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is a xanthophyll. Accordingly, in the present invention, the term "the fine chemical" as used herein relates to a "Xanthophyll". Further, the term "the fine chemicals" as used herein also relates to fine chemicals comprising xanthophylls.

In one embodiment, the term "xanthophylls", "the fine chemical" or "the respective fine chemical" means at least one chemical compound with xanthophylls activity selected from the group comprising zeaxanthin or β-cryptoxanthin. Throughout the specification the term "the fine chemical" or "the respective fine chemical" means at xanthophylls especially selected from the group comprising zeaxanthin or β-cryptoxanthin in free form or bound to other compounds such as membrane lipids. In one embodiment, the term "the fine chemical" and the term "the respective fine chemical" mean at least one chemical compound with an activity of the above-mentioned fine chemical.

Accordingly, the present invention relates to a process for the production of xanthophylls preferably zeaxanthin and/or cryptoxanthin, which comprises (a) increasing or generating the activity of a protein as shown in table II, application no. 11, column 3 encoded by the nucleic acid sequences as shown in table I, application no. 11, column 5, in an organelle of a microorganism or plant, or (b) increasing or generating the activity of a protein as shown in table II, application no. 11, column 3 encoded by the nucleic acid sequences as shown in table I, application no. 11, column 5 in the plastid of a microorganism or plant, or in one or more parts thereof; and (c) growing the organism under conditions which permit the production of the fine chemical, thus, xanthophylls preferably zeaxanthin and/or cryptoxanthin or fine chemicals comprising xanthophylls preferably zeaxanthin and/or cryptoxanthin, in said organism or in the culture medium surrounding the organism.

Accordingly, the term "the fine chemical" means "betacryptoxanthin" in relation to all sequences listed in table I, application no. 11, columns 3 and 7 or homologs thereof. Accordingly, the term "the fine chemical" can mean "zeaxanthin" or "cryptoxanthin", owing to circumstances and the context. Preferably the term "the fine chemical" means "zeaxanthin". In order to illustrate that the meaning of the term "the respective fine chemical" means "cryptoxanthin", and/or "zeaxanthin" owing to the sequences listed in the context the term "the respective fine chemical" is also used.

The terms "beta-cryptoxanthin" and "cryptoxanthin" are used as equivalent terms.

In another embodiment the present invention is related to a process for the production of xanthophylls, preferably zeaxanthin and/or cryptoxanthin, which comprises (a) increasing or generating the activity of a protein as shown in table II, application no. 11, column 3 encoded by the nucleic acid sequences as shown in table I, application no. 11, column 5, in an organelle of a non-human organism, or (b) increasing or generating the activity of a protein as shown in table II, application no. 11, column 3 encoded by the nucleic acid sequences as shown in table I, application no. 11, column 5, which are joined to a nucleic acid sequence encoding a transit peptide in a non-human organism, or in one or more parts thereof; or (c) increasing or generating the activity of a protein as shown in table II, application no. 11, column 3 encoded by the nucleic acid sequences as shown in table I, application no. 11, column 5, which are joined to a nucleic acid sequence encoding chloroplast localization sequence, in a non-human organism, or in one or more parts thereof, and (d) growing the organism under conditions which permit the production of xanthophylls, preferably zeaxanthin and/or cryptoxanthin in said organism.

In another embodiment, the present invention relates to a process for the production of xanthophylls, preferably zeaxanthin and/or cryptoxanthin, which comprises (a) increasing or generating the activity of a protein as shown in table II, application no. 11, column 3 encoded by the nucleic acid sequences as shown in table I, application no. 11, column 5, in an organelle of a microorganism or plant through the transformation of the organelle, or (b) increasing or generating the activity of a protein as shown in table II, application no. 11, column 3 encoded by the nucleic acid sequences as shown in table I, application no. 11, column 5 in the plastid of a microorganism or plant, or in one or more parts thereof through the transformation of the plastids; and (c) growing the organism under conditions which permit the production of the fine chemical, thus, xanthophylls, preferably zeaxanthin and/or cryptoxanthin or fine chemicals comprising xanthophylls, preferably zeaxanthin and/or cryptoxanthin, in said organism or in the culture medium surrounding the organism.

Advantageously the activity of the protein as shown in table II, application no. 11, column 3 encoded by the nucleic acid sequences as shown in table I, application no. 11, column 5 is increased or generated in the abovementioned process in the plastid of a microorganism or plant.

for the disclosure of the paragraphs [0019.0.0.10] to [0024.0.0.10] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 11, columns 5 and 7. Most preferred nucleic acid sequences encoding transit peptides are derived from the genus *Spinacia* such as chloroplast 30S ribosomal protein PSrp-1, root acyl carrier protein 11, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-tranlationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 11, column 3 and its homologs as disclosed in table I, application no. 11, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 11, column 3 and its homologs as disclosed in table I, application no. 11, columns 5 and 7.

for the disclosure of the paragraphs [0027.0.0.10] to [0029.0.0.10] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 11, columns 5 and 7. The person skilled in the art is able to join said sequences in a functional manner. Advantageously the transit peptide part is cleaved off from the protein part shown in table II, application no. 11, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 11, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 11, columns 5 and 7. In case of the amino acid sequence QIA CSS the three amino acids in front of the start methionine are stemming from the LIC (=ligatation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 11, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 11, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 11, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.10] and [0030.3.0.10] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 11, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 11, columns 5 and 7 or a sequence encoding a protein, as depicted in table II, application no. 11, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 11, columns 5 and 7 or a sequence encoding a protein, as depicted in table II, application no. 11, columns 5 and 7 in such a manner that the viroid sequence transports a sequence transcribed from a sequence as depicted in table I, application no. 11, columns 5 and 7 or a sequence encoding a protein as depicted in table II, application no. 11, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 11, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 11, columns 5 and 7.

In a preferred embodiment of the invention the nucleic acid sequences as shown in table I, application no. 11, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 11, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.10] and [0032.0.0.10] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 11, column 3. Preferably the modification of the activity of a protein as shown in table II, application no. 11, column 3 or their combination can be achieved by joining the protein to a transit peptide.

Surprisingly it was found, that the transgenic expression of the *Saccaromyces cerevisiae* protein as shown in table II, application no. 11, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b1095 (Accession number NP_415613) from *Escherichia coli* has been published in Blattner et al., Science 277 (5331), 1453-1474 (1997), and its activity is being defined as "3-oxoacyl-[acyl-carrier-protein] synthase II". Accordingly, in one embodiment, the process of the present invention comprises the use of a "3-oxoacyl-[acyl-carrier-protein] synthase 11" or its homolog, e.g. as shown herein, for the production of the fine chemical, meaning of xanthophylls and/or triglycerides, lipids, oils and/or fats containing xanthophylls, in particular for increasing the amount of xanthophylls in free or bound form in an organism or a part thereof, as mentioned. In one embodiment, in the process of the present invention the activity of a b1095 protein is increased or generated, e.g. from *Escherichia coli* or a homolog thereof, preferably linked at least to one transit peptide as mentioned for example in table V.

In another embodiment, in the process of the present invention the activity of a b1095 protein is increased or generated in a subcellular compartment of the organism or organism cell such as in an organelle like a plastid or mitochondria.

The sequence of b2022 (Accession number NP_416526) from *Escherichia coli* has been published in Blattner et al., Science 277 (5331), 1453-1474 (1997), and its activity is being defined as "bifunctional histidinol-phosphatase/imidazoleglycerol-phosphate dehydratase". Accordingly, in one embodiment, the process of the present invention comprises the use of a "bifunctional histidinol-phosphatase/imidazoleglycerol-phosphate dehydratase" or its homolog, e.g. as shown herein, for the production of the fine chemical, meaning of xanthophylls and/or triglycerides, lipids, oils and/or fats containing xanthophylls, in particular for increasing the amount of xanthophylls in free or bound form in an organism or a part thereof, as mentioned. In one embodiment, in the process of the present invention the activity of a b2022 protein is increased or generated, e.g. from *Escherichia coli* or a homolog thereof, preferably linked at least to one transit peptide as mentioned for example in table V.

In another embodiment, in the process of the present invention the activity of a b2022 protein is increased or generated in a subcellular compartment of the organism or organism cell such as in an organelle like a plastid or mitochondria.

The sequence of b2344 (Accession number PIR:F65007) from *Escherichia coli* has been published in Blattner et al., Science 277 (5331), 1453-1474 (1997), and its activity is being defined as "outer membrane porin, transport of long-chain fatty acids, sensitivity to phage T2". Accordingly, in one embodiment, the process of the present invention comprises the use of a "outer membrane porin, transport of long-chain fatty acids, sensitivity to phage T2" or its homolog, e.g. as shown herein, for the production of the fine chemical, meaning of xanthophylls and/or triglycerides, lipids, oils and/or fats containing xanthophylls, in particular for increasing the amount of xanthophylls in free or bound form in an organism or a part thereof, as mentioned. In one embodiment, in the process of the present invention the activity of a b2344 protein is increased or generated, e.g. from *Escherichia coli* or a homolog thereof, preferably linked at least to one transit peptide as mentioned for example in table V.

In another embodiment, in the process of the present invention the activity of a b2344 protein is increased or generated in a subcellular compartment of the organism or organism cell such as in an organelle like a plastid or mitochondria.

In one embodiment, the homolog of the b1095, b2022 and/or b2344 is a homolog having said activity and being derived from bacteria. In one embodiment, the homolog of the b1095, b2022 and/or b2344 is a homolog having said activity and being derived from Proteobacteria. In one embodiment, the homolog of the b1095, b2022 and/or b2344 is a homolog having said activity and being derived from Gammaproteobacteria. In one embodiment, the homolog of the b1095, b2022 and/or b2344 is a homolog having said activity and being derived from Enterobacteriales. In one embodiment, the homolog of the b1095, b2022 and/or b2344 is a homolog having said activity and being derived from Enterobacteriaceae. In one embodiment, the homolog of the b1095, b2022 and/or b2344 is a homolog having said activity and being derived from *Escherichia*, preferably from *Escherichia coli*.

for the disclosure of this paragraph see paragraph [0038.0.0.0] above.

In accordance with the invention, a protein or polypeptide has the "activity of an protein as shown in table II, application no. 11, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 11, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 11, column 3, or which has at least 10% of the original enzymatic activity, preferably 20%, particularly preferably 30%, most particularly preferably 40% in comparison to a protein as shown in table II, application no. 11, column 3 of *Saccharomyces cerevisiae*.

for the disclosure of the paragraphs [0040.0.0.10] to [0047.0.0.10] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 11, column 3 its biochemical or genetical causes and the increased amount of the fine chemical.

for the disclosure of the paragraphs [0049.0.0.10] to [0051.0.0.10] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 11, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.10] to [0058.0.0.10] see paragraphs [0053.0.0.0] to [0058.0.0.0] above.

In case the activity of the *Escherichia coli* protein b1095 or its homologs, e.g. a "3-oxoacyl-[acyl-carrier-protein] synthase II" is increased advantageously in an organelle such as a plastid or mitochondria, preferably, in one embodiment an increase of the fine chemical, preferably of xanthophylls, more preferably zeaxanthin between 25% and 37% or more is conferred.

In case the activity of the *Escherichia coli* protein b2022 or its homologs, e.g. a "bifunctional histidinol-phosphatase/imidazoleglycerol-phosphate dehydratase" is increased advantageously in an organelle such as a plastid or mitochondria, preferably, in one embodiment an increase of the fine chemical, preferably of xanthophylls, more preferably zeaxanthin between 23% and 29% or more is conferred.

In case the activity of the *Escherichia coli* protein b2344 or its homologs, e.g. a "outer membrane porin, transport of long-chain fatty acids, sensitivity to phage T2" is increased advantageously in an organelle such as a plastid or mitochondria, preferably, in one embodiment an increase of the fine chemical, preferably of xanthophylls, more preferably zeaxanthin between 27% and 90% or more is conferred.

In case the activity of the *Escherichia coli* proteins b1095, b2022 and/or b2344 or their homologs, are increased advantageously in an organelle such as a plastid or mitochondria, preferably an increase of the fine chemical xanthophylls, more preferably zeaxanthin is conferred.

for the disclosure of the paragraphs [0061.0.0.10] and [0062.0.0.10] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 11, column 7 or of the polypeptide as shown in the amino acid sequences as disclosed in table II, application no. 11, columns 5 and 7 or the functional homologues thereof as described herein, or is encoded by the nucleic acid molecule characterized herein or the nucleic acid molecule according to the invention, for example by the nucleic acid molecule as shown in table I, application no. 11, columns 5 and 7 or its herein described functional homologues and has the herein mentioned activity.

/ for the disclosure of the paragraphs [0065.0.0.10] and [0066.0.0.10] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 11, columns 5 and 7 or its homologs activity having herein-mentioned xanthophylls, preferably cryptoxanthin and/or zeaxanthin increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 11, columns 5 and 7, e.g. a nucleic acid sequence encoding a polypeptide having the activity of a protein as indicated in table II, application no. 11, columns 5 and 7 or its homologs activity or of a mRNA encoding the polypeptide of the present invention having herein-mentioned xanthophylls, preferably cryptoxanthin and/or zeaxanthin increasing activity; and/or c) increasing the specific activity of a protein conferring the increased expression of a protein encoded by the nucleic acid molecule of the invention or of the polypeptide of the present invention having herein-mentioned xanthophylls, preferably cryptoxanthin and/or zeaxanthin increasing activity, e.g. of a polypeptide having the activity of a protein as indicated in table II, application no. 11, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned xanthophylls, preferably cryptoxanthin and/or zeaxanthin increasing activity, e.g. of a polypeptide having the activity of a protein as indicated in table II, application no. 11, columns 5 and 7 or its homologs activity; and/or e) stimulating activity of a protein conferring the increased expression of a protein encoded by the nucleic acid molecule of the present invention or a polypeptide of the present invention having herein-mentioned xanthophylls, preferably cryptoxanthin and/or zeaxanthin increasing activity, e.g. of a polypeptide having the activity of a protein as indicated in table II, application no. 11, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned xanthophylls, preferably cryptoxanthin and/or zeaxanthin increasing activity, e.g. of a polypeptide having the activity of a protein as indicated in table II, application no. 11, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned xanthophylls, preferably cryptoxanthin and/or zeaxanthin increasing activity, e.g. of a polypeptide having the activity of a protein as indicated in table II, application no. 11, columns 5 and 7 or its homologs activity; and/or h) increasing the expression of the endogenous gene encoding the polypeptide of the invention, e.g. a polypeptide having the activity of a protein as indicated in table II, application no. 11, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned xanthophylls, preferably cryptoxanthin and/or zeaxanthin increasing activity, e.g. of polypeptide having the activity of a protein as indicated in table II, application no. 11, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned xanthophylls, preferably cryptoxanthin and/or zeaxanthin increasing activity, e.g. of a polypeptide having the activity of a protein as indicated in table II, application no. 11, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned xanthophylls, preferably cryptoxanthin and/or zeaxanthin increasing activity, e.g. of a polypeptide having the activity of a protein as indicated in table II, application no. 11, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 11, column 3 or its homologs. Preferably the increase of the fine chemical takes place in plastids.

for the disclosure of the paragraphs [0069.0.0.10] to [0079.0.0.10] see paragraphs [0069.0.0.0] to [0079.0.0.0] above.

The activation of an endogenous polypeptide having above-mentioned activity, e.g. having the activity of a protein as shown in table II, application no. 11, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 11, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 11, column 3. The expression of the chimeric transcription factor in a organism, in particular in a plant, leads to a specific expression of the protein as shown in table II, application no. 11, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.10] to [0084.0.0.10] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic. acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous xanthophyll composition comprising a higher content of (from a viewpoint of nutritional physiology limited) xanthopylls, like violaxanthin, antheraxanthin, lutein, astaxanthin, canthaxanthin and/or fucoxanthin.

for the disclosure of this paragraph see paragraph [0086.0.0.0] above.

By influencing the metabolism thus, it is possible to produce, in the process according to the invention, further advantageous compounds. Examples of such compounds are, in addition to xanthophylls, triglycerides, lipids, oils and/or fats containing xanthophylls compounds such as zeaxanthin, cryptoxanthin, violaxanthin, antheraxanthin, lutein, astaxanthin, canthaxanthin and/or fucoxanthin preferably zeaxanthin and/or cryptoxanthin.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 11, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound xanthopylls, in particular zeaxanthin and/or cryptoxanthin.

for the disclosure of the paragraphs [0090.0.0.10] to [0097.0.0.10] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 11, columns 5 and 7 or a derivative thereof, or b) a genetic regulatory element, for example a promoter, which is functionally linked to the nucleic acid sequence as shown table I, application no. 11, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 11, columns 5 and 7 joined to a nucleic acid sequence encoding a transit peptide, or a targeting nucleic acid sequence which directs the nucleic acid sequences disclosed in table I, application no. 11, columns 5 and 7 to the organelle preferentially the plastids. Altenatively the inventive nucleic acids sequences consist advantageously of the nucleic acid sequences as depicted in the sequence protocol and disclosed in table I, application no. 11, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose xanthophyll content is modified advantageously owing to the nucleic acid molecule of the present invention expressed. This is important for plant breeders since, for example, the nutritional value of plants for poultry is dependent on the abovementioned xanthopylls and the general amount of xanthopylls as energy source and/or protecting compounds in feed. After the activity of the protein as shown in table II, application no. 11, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.10] to [0110.0.0.10] see paragraphs [0102.0.0.0] to [0110.0.0.0] above.

In a preferred embodiment, the fine chemical (xanthophyll) is produced in accordance with the invention and, if desired, is isolated. The production of further xanthophylss such as zeaxanthin, cryptoxanthin, violaxanthin, antheraxanthin, lutein, astaxanthin, canthaxanthin and/or fucoxanthin and mixtures thereof or mixtures of other xanthophylls by the process according to the invention is advantageous. It may be advantageous to increase the pool of free xanthophylls in the transgenic organisms by the process according to the invention in order to isolate high amounts of the pure fine chemical.

In another preferred embodiment of the invention a combination of the increased expression of the nucleic acid sequence or the protein of the invention together with the transformation of anucleic acid encoding a protein or polypeptide for example another gene of the xanthopyhll biosynthesis, or a compound, which functions as a sink for the desired xanthopyhll for example for xanthophylls like zeaxanthin, cryptoxanthin, violaxanthin, antheraxanthin, lutein, astaxanthin, canthaxanthin and/or fucoxanthin, preferably zeaxanthin and/or cryptoxanthin in the organism is useful to increase the production of the respective fine chemical.

In a preferred embodiment, the respective fine chemical is produced in accordance with the invention and, if desired, is isolated. The production of further carotenoids, e.g. carotenes or xanthophylls, in particular ketocarentoids or hydrocarotenoids, e.g. lutein, lycopene, alpha-carotene, or beta-carotene, or compounds for which the respective fine chemical is a biosynthesis precursor compounds, e.g. astaxanthin, or mixtures thereof or mixtures of other carotenoids, in particular of xanthophylls, by the process according to the invention is advantageous.

In the case of the fermentation of microorganisms, the above-mentioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the carotenoids such as said xanthophylls, e.g. cryptoxanthin or zeaxanthin (or astaxanthin as it is synthesized from cryptoxanthin or zeaxanthin) synthesized in the process according to the invention can advantageously be marketed directly without there being any need for the carotenoids synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue. However, the respective fine chemical produced in the process according to the invention can also be isolated from the organisms, advantageously plants, (in the form of their oils, fats, lipids, as extracts, e.g. ether, alcohol, or other organic solvents or water containing extract and/or free xanthophylls. The respective fine chemical produced by this process can be obtained by harvesting the organisms, either from the medium in which they grow, or from the field. This can be done via pressing or extraction of the plant parts. To increase the efficiency of extraction it is beneficial to clean, to temper and if necessary to hull and to flake the plant material. E.g., oils, fats, and/or lipids comprising xanthophylls can be obtained by what is known as cold beating or cold pressing without applying heat. To allow for greater ease of disruption of the plant parts, specifically the seeds, they can previously be comminuted, steamed or roasted. Seeds, which have been pretreated in this manner can subsequently be pressed or extracted with solvents such as warm hexane. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid.

Because carotenoids in microorganisms are localized intracellular, their recovery essentials comes down to the isolation of the biomass. Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose. However, it can be advantageous to avoid this treatment as it can result in cells devoid of most carotenoids.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Xanthophylls, in particular beta-cryptoxanthin or zeaxanthin can for example be detected advantageously via HPLC, LC or GC separation methods. The unambiguous detection for the presence of xanthophylls, in particular beta-cryptoxanthin or zeaxanthin containing products can be obtained by analyzing recombinant organisms using analytical standard methods: LC, LC-MS, MS or TLC). The material to be analyzed can be disrupted by sonication, grinding in a glass mill, liquid nitrogen and grinding, cooking, or via other applicable methods In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:
a) nucleic acid molecule encoding, preferably at least the mature form, of the polypeptide shown in table II, application no. 11, columns 5 and 7 or a fragment thereof, which confers an increase in the amount of the fine chemical in an organism or a part thereof;
b) nucleic acid molecule comprising, preferably at least the mature form, of the nucleic acid molecule shown in table I, application no. 11, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybidizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 11, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 11, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 11, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;
or which comprises a sequence which is complementary thereto.

In one embodiment, the nucleic acid molecule used in the process of the invention distinguishes over the sequence indicated in table IA, application no. 11, columns 5 and 7 by one or more nucleotides. In one embodiment, the nucleic acid molecule used in the process of the invention does not consist of the sequence indicated in table IA, application no. 11, columns 5 and 7. In one embodiment, the nucleic acid molecule used in the process of the invention is less than 100%, 99.999%, 99.99%, 99.9% or 99% identical to a sequence indicated in table IA, application no. 11, columns 5 and 7. In another embodiment, the nucleic acid molecule does not encode a polypeptide of a sequence indicated in table IIA, application no. 11, columns 5 and 7.

In one embodiment, the nucleic acid molecule used in the process of the invention distinguishes over the sequence indicated in table IB, application no. 11, columns 5 and 7, by one or more nucleotides. In one embodiment, the nucleic acid molecule used in the process of the invention does not consist of the sequence indicated in table IB, application no. 11, columns 5 and 7. In one embodiment, the nucleic acid molecule used in the process of the invention is less than 100%, 99.999%, 99.99%, 99.9% or 99% identical to a sequence indicated in table IB, application no. 11, columns 5 and 7. In another embodiment, the nucleic acid molecule does not encode a polypeptide of a sequence indicated in table IIB, application no. 11, columns 5 and 7.

In one embodiment, the nucleic acid molecule used in the process distinguishes over the sequence shown in table I, application no. 11, columns 5 and 7 by one or more nucleotides or does not consist of the sequence shown in table I, application no. 11, columns 5 and 7. In one embodiment, the nucleic acid molecule of the present invention is less than 100%, 99.999%, 99.99%, 99.9% or 99% identical to the sequence shown in table I, application no. 11, columns 5 and 7. In another embodiment, the nucleic acid molecule does not encode a polypeptide of the sequence shown in table II, application no. 11, columns 5 and 7.

for the disclosure of the paragraphs [0118.0.0.10] to [0120.0.0.10] see paragraphs [0118.0.0.0] to [0120.0.0.0] above.

Nucleic acid molecules with the sequence shown in table I, application no. 11, columns 5 and 7, nucleic acid molecules which are derived from the amino acid sequences shown in table II, application no. 11, columns 5 and 7 or from polypeptides comprising the consensus sequence shown in table IV, application no. 11, column 7, or their derivatives or homologues encoding polypeptides with the enzymatic or biological activity of a protein as shown in table II, application no. 11, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 11, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 11, column 3 and conferring the fine chemical increase by expression either in the cytsol or in an organelle such as a plastid or mitochondria or both, preferably in plastids.

for the disclosure of the paragraphs [0126.0.0.10] to [0133.0.0.10] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 11, columns 5 and 7 or the functional homologues thereof as described herein, preferably conferring above-mentioned activity, i.e. conferring the fine chemical increase after increasing its activity, e.g. after increasing the activity of a protein as shown in table II, application no. 11, column 3 by for example expression either in the cytsol or in an organelle such as a plastid or mitochondria or both, preferably in plastids.

for the disclosure of the paragraphs [0135.0.0.10] to [0140.0.0.10] see paragraphs [0135.0.0.0] to [0140.0.0.0] above.

Synthetic oligonucleotide primers for the amplification, e.g. as shown in table III, application no. 11, column 7, by means of polymerase chain reaction can be generated on the basis of a sequence shown herein, for example the sequence shown in table I, application no. 11, columns 5 and 7 or the sequences derived from table II, application no. 11, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 11, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 11, column 3 or further functional homologs of the polypeptide of the invention from other organisms.

for the disclosure of the paragraphs [0144.0.0.10] to [0151.0.0.10] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 11, columns 5 and 7, preferably of table IB, application no. 11, columns 5 and 7 under relaxed hybridization conditions and which code on expression for peptides having the xanthophyll preferably zeaxanthin and/or cryptoxanthin or lipids, oils and/or fats containing xanthophyll preferably zeaxanthin and/or cryptoxanthin increasing activity.

for the disclosure of the paragraphs [0153.0.0.10] to [0159.0.0.10] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 11, columns 5 and 7, preferably shown in table IB, application no. 11, columns 5 and 7 is one which is sufficiently complementary to one of the nucleotide sequences shown in table I, application no. 11, columns 5 and 7, preferably shown in table IB, application no. 11, columns 5 and 7 such that it can hybridize to one of the nucleotide sequences shown in table I, application no. 11, columns 5 and 7, preferably shown in table IB, application no. 11, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 11, columns 5 and 7, preferably shown in table IB, application no. 11, columns 5 and 7, or a portion thereof and preferably has above mentioned activity, in particular having a fine chemical increasing activity after increasing the activity or an activity of a gene product as shown in table II, application no. 11, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 11, columns 5 and 7, preferably shown in table IB, application no. 11, columns 5 and 7, or a portion thereof and encodes a protein having above-mentioned activity, e.g. conferring of a xanthophyll preferably zeaxanthin and/or cryptoxanthin, triglycerides, lipids, oils and/or fats containing xanthophyll preferably zeaxanthin and/or cryptoxanthin increase by for example expression either in the cytsol or in an organelle such as a plastid or mitochondria or both, preferably in plastids, and optionally, the activity of a protein as shown in table II, application no. 11, column 3.

Moreover, the nucleic acid molecule of the invention can comprise only a portion of the coding region of one of the sequences shown in table I, application no. 11, columns 5 and 7, preferably shown in table IB, application no. 11, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 11, columns 5 and 7, an anti-sense sequence of one of the sequences, e.g., set forth in table I, application no. 11, columns 5 and 7, preferably shown in table IB, application no. 11, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 11, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 11, columns 5 and 7 such that the protein or portion thereof maintains the ability to participate in the fine chemical production, in particular a xanthophyll preferably zeaxanthin and/or cryptoxanthin, triglycerides, lipids, oils and/or fats containing xanthophylls preferably zeaxanthin and/or cryptoxanthin increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 11, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 11, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.10] and [0169.0.0.10] see paragraphs [0168.0.0.0] and [0169.0.0.0] above.

The invention further relates to nucleic acid molecules that differ from one of the nucleotide sequences shown in table I, application no. 11, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 11, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 11, columns 5 and 7 or the functional homologues. In a still further embodiment, the nucleic acid molecule of the invention encodes a full length protein which is substantially homologous to an amino acid sequence shown in table II, application no. 11, columns 5 and 7 or the functional homologues. However, in a preferred embodiment, the nucleic acid molecule of the present invention does not consist of the sequence shown in table I, application no. 11, columns 5 and 7, preferably as indicated in table IA, application no. 11, columns 5 and 7. Preferably the nucleic acid molecule of the invention is a functional homologue or identical to a nucleic acid molecule indicated in table IB, application no. 11, columns 5 and 7.

for the disclosure of the paragraphs [0171.0.0.10] to [0173.0.0.10] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 11, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 11, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 11, columns 5 and 7.

for the disclosure of the paragraphs [0179.0.0.10] and [0180.0.0.10] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 11, columns 5 and 7, preferably shown in table IIA, application no. 11, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 11, columns 5 and 7, preferably shown in table IIA, application no. 11, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 11, columns 5 and 7, preferably shown in table IIA, application no. 11, columns 5 and 7, more preferably at least about 70% identical to one of the sequences shown in table II, application no. 11, columns 5 and 7, preferably shown in table IIA, application no. 11, columns 5 and 7, even more preferably at least about 80%, 90%, 95% homologous to the sequence shown in table II, application no. 11, columns 5 and 7, preferably shown in table IIA, application no. 11, columns 5 and 7, and most preferably at least about 96%, 97%, 98%, or 99% identical to the sequence shown in table II, application no. 11, columns 5 and 7, preferably shown in table IIA, application no. 11, columns 5 and 7.

for the disclosure of the paragraphs [0182.0.0.10] to [0188.0.0.10] see paragraphs [0182.0.0.0] to [0188.0.0.0] above.

Functional equivalents derived from one of the polypeptides as shown in table II, application no. 11, columns 5 and 7, preferably shown in table IIB, application no. 11, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 11, columns 5 and 7, preferably shown in table IIB, application no. 11, columns 5 and 7 resp., according to the invention and are distinguished by essentially the same properties as the polypeptide as shown in table II, application no. 11, columns 5 and 7, preferably shown in table IIB, application no. 11, columns 5 and 7.

Functional equivalents derived from the nucleic acid sequence as shown in table I, application no. 11, columns 5 and 7, preferably shown in table IB, application no. 11, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 11, columns 5 and 7, preferably shown in table IIB, application no. 11, columns 5 and 7 resp., according to the invention and encode polypeptides having essentially the same properties as the polypeptide as shown in table II, application no. 11, columns 5 and 7, preferably shown in table IIB, application no. 11, columns 5 and 7.

for the disclosure of this paragraph see paragraph [0191.0.0.0] above.

A nucleic acid molecule encoding an homologous to a protein sequence of table II, application no. 11, columns 5 and 7, preferably shown in table IIB, application no. 11, columns 5 and 7 resp., can be created by introducing one or more nucleotide substitutions, additions or deletions into a nucleotide sequence of the nucleic acid molecule of the present invention, in particular of table I, application no. 11, columns 5 and 7, preferably shown in table IB, application no. 11, columns 5 and 7 resp., such that one or more amino acid substitutions, additions or deletions are introduced into the encoded protein. Mutations can be introduced into the encoding sequences of table I, application no. 11, columns 5 and 7, preferably shown in table IB, application no. 11, columns 5 and 7 resp., by standard techniques, such as site-directed mutagenesis and PCR-mediated mutagenesis.

for the disclosure of the paragraphs [0193.0.0.10] to [0196.0.0.10] see paragraphs [0193.0.0.0] to [0196.0.0.0] above.

Homologues of the nucleic acid sequences used, with the sequence shown in table I, application no. 11, columns 5 and 7, preferably shown in table IB, application no. 11, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 11, columns 5 and 7, preferably shown in table IB, application no. 11, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 11, columns 5 and 7, preferably shown in table IB, application no. 11, columns 5 and 7. It is preferred that the nucleic acid molecule comprises as little as possible other nucleotides not shown in any one of table I, application no. 11, columns 5 and 7, preferably shown in table IB, application no. 11, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 11, columns 5 and 7, preferably shown in table IB, application no. 11, columns 5 and 7.

Also preferred is that the nucleic acid molecule used in the process of the invention encodes a polypeptide comprising the sequence shown in table II, application no. 11, columns 5 and 7, preferably shown in table IIB, application no. 11, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 11, columns 5 and 7, preferably shown in table IIB, application no. 11, columns 5 and 7.

In one embodiment, the nucleic acid molecule of the invention or used in the process encodes a polypeptide comprising the sequence shown in table II, application no. 11, columns 5 and 7, preferably shown in table IIB, application no. 11, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 11, columns 5 and 7, preferably shown in table IB, application no. 11, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 11, columns 5 and 7 expressed under identical conditions.

Homologues of table I, application no. 11, columns 5 and 7 or of the derived sequences of table II, application no. 11, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.10] to [0215.0.0.10] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 11, columns 5 and 7, preferably in table IIB, application no. 11, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 11, columns 5 and 7, preferably in table IB, application no. 11, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 11, column 7 and conferring an increase in the amount of the fine chemical in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising the consensus sequence shown in table IV, application no. 11, column 7 and conferring an increase in the amount of the fine chemical in an organism or a part thereof;
k) nucleic acid molecule encoding the amino acid sequence of a polypeptide encoding a domain of the polypeptide shown in table II, application no. 11, columns 5 and 7 and conferring an increase in the amount of the fine chemical in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 11, columns 5 and 7 or a nucleic acid molecule encoding, preferably at least the mature form of, the polypeptide shown in table II, application no. 11, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 11, columns 5 and 7 by one or more nucleotides. In one embodiment, the nucleic acid molecule of the invention does not consist of the sequence shown in table IA and/or IB, application no. 11, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 11, columns 5 and 7. In a further embodiment the nucleic acid molecule does not encode the polypeptide sequence shown in table IIA and/or IIB, application no. 11, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 11, columns 5 and 7 does not encode a protein of the sequence shown in table IIA and/or IIB, application no. 11, columns 5 and 7. Accordingly, in one embodiment, the protein encoded by a sequence of a nucleic acid according to (a) to (l) does not consist of the sequence shown in table IA and/or IB, application no. 11, columns 5 and 7. In a further embodiment, the protein of the present invention is at least 30% identical to protein sequence depicted in table IIA and/or IIB, application no. 11, columns 5 and 7 and less than 100%, preferably less than 99.999%, 99.99% or 99.9%, more preferably less than 99%, 985, 97%, 96% or 95% identical to the sequence shown in table IIA and/or IIB, application no. 11, columns 5 and 7.

for the disclosure of the paragraphs [0217.0.0.10] to [0226.0.0.10] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 11, columns 5 and 7 can be cloned 3'prime to the transitpeptide encoding sequence, leading to a functional pre-protein, which is directed to the plastids and which means that the mature protein fulfills its biological activity.

for the disclosure of the paragraphs [0228.0.0.10] to [0239.0.0.10] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorgansms.

In addition to the sequence mentioned in Table I, application no. 11, columns 5 and 7 or its derivatives, it is advantageous additionally to express and/or mutate further genes in the organisms. Especially advantageously, additionally at least one further gene of xanthophyll biosynthetic pathway such as for cryptoxanthin or zeaxanthin, e.g. one of the above mentioned genes of this pathway, or e.g. for the synthesis of astaxanthin or for another provitamin A or for another carotenoids is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 11, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the xanthophyll metabolism, in particular in synthesis of beta-cryptoxanthin, zeaxanthin, astaxanthin or lutein. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the above-mentioned biosynthesis genes are the sequences encoding further genes of the carotenoids biosynthetic pathway, such as phytoene synthase (Psy), which is an important control point for the regulation of the flux (Fraser et al., 2002), phytoene desaturase (Pds), z-carotene desaturase, above mentioned enzymes (s. introduction of the application), e.g. hydroxylases such as beta-carotene hydroxylase (U.S. Pat. No. 6,214,575), ketolases, or cyclases such as the beta-cyclase (U.S. Pat. No. 6,232,530) or oxygenases such as the beta-C4-oxygenase described in U.S. Pat. No. 6,218,599 or homologs thereof, astaxanthin synthase (U.S. Pat. No. 6,365,386), or other genes as described in U.S. Pat. No. 6,150,130. These genes can lead to an increased synthesis of the essential carotenoids, in particular xanthophylls.

In a further advantageous embodiment of the process of the invention, the organisms used in the process are those in which simultaneously a zeaxanthin or cryptoxanthin degrading protein is attenuated, in particular by reducing the rate of expression of the corresponding gene, or by inactivating the gene for example the mutagenesis and/or selection. In another advantageous embodiment the synthesis of competitive pathways which rely on the same precursors are down regulated or interrupted. A person skilled in the art knows for example, that the inhibition of the lutein synthesis from carotene increases the amount of cryptoxanthin and zeaxanthin in an organism, in particular in plants. In one embodiment, the level of astaxanthin in the organism shall be increased. Thus, astaxanthin degrading enzymes are attenuated but not enzymes catalyzing the synthesis of astaxanthin from zeaxanthin or cryptoxanthin.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemical and other xanthophylls produced by this process can be obtained by harvesting the organisms, either from the crop in which they grow, or from the field. This can be done via pressing or extraction of the plant parts.

Preferably, the compound is a composition comprising the essentially pure cryptoxanthin or zeaxanthin or a recovered or isolated cryptoxanthin or zeaxanthin, in particular, the respective fine chemical, free or in protein- and/or lipid-bound form.

for the disclosure of the paragraphs [0243.0.0.10] to [0264.0.0.10] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide or transit-peptide-encoding sequences which are known per se. For example, plastid transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 11, columns 5 and 7 and described herein to achieve an expression in one of said compartments or extracellular.

for the disclosure of the paragraphs [0266.0.0.10] to [0287.0.0.10] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 11, columns 5 and 7 or their homologs is functionally linked to a plastidial targeting sequence. A further preferred embodiment of the invention relates to a vector in which a nucleic acid sequence encoding one of the polypeptides shown in table II, application no. 11, columns 5 and 7 or their homologs is functionally linked to a regulatory sequences which permit the expression in plastids.

for the disclosure of the paragraphs [0289.0.0.10] to [0296.0.0.10] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b1095, anti-2022 and/or anti-b2344 protein antibody or an antibody against polypeptides as shown in table II, application no. 11, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 11, columns 5 and 7 or as coded by the nucleic acid molecule shown in table I, application no. 11, columns 5 and 7 or functional homologues thereof.

In one advantageous embodiment, in the method of the present invention the activity of a polypeptide is increased comprising or consisting of the consensus sequence shown in table IV, application no. 11, columns 7 and in one another embodiment, the present invention relates to a polypeptide comprising or consisting of the consensus sequence shown in table IV, application no. 11, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.10] to [0304.0.0.10] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 11, columns 5 and 7 by one or more amino acids. In one embodiment, polypeptide distinguishes form the sequence shown in table IIA and/or IIB, application no. 11, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 11, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 11, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 11, columns 5 and 7 by one or more amino acids. In another embodiment, said polypeptide of the invention does not consist of the sequence shown in table IIA and/or IIB, application no. 11, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 11, columns 5 and 7.

In one embodiment, the present invention relates to a polypeptide having the activity of the protein as shown in table IIA and/or IIB, application no. 11, column 3, which distinguishes over the sequence depicted in table IIA and/or IIB, application no. 11, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.10] to [0311.0.0.10] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 11, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 11, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 11, columns 5 and 7 or which is homologous thereto, as defined above.

Accordingly the polypeptide of the present invention can vary from the sequences shown in table IIA and/or IIB, application no. 11, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 11, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 11, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 11, column 3. Differences shall mean at least one amino acid different from the sequences as shown in table II, application no. 11, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 11, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 11, column 3. The nucleic acid molecules and polypeptide molecules of the invention are expressed such that the yield, production, and/or efficiency of production of a desired compound is improved.

for the disclosure of the paragraphs [0320.0.0.10] to [0322.0.0.10] see paragraphs [0320.0.0.0] to [0322.0.0.0] above.

In one embodiment, a protein (=polypeptide) as shown in table II, application no. 11, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 11, column 3, e.g., a protein which does not confer the activity described herein and which is derived from the same or a different organism.

for the disclosure of the paragraphs [0324.0.0.10] to [0329.0.0.10] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 11, columns 5 and 7.

for the disclosure of the paragraphs [0331.0.0.10] to [0346.0.0.10] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 11, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 11, column 3 or a protein as shown in table II, application no. 11, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 11, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.10] to [0358.0.0.10] see paragraphs [0350.0.0.0] to [0358.0.0.0] above.

Transgenic plants comprising the xanthophylls preferably zeaxanthin and/or cryptoxanthin synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The xanthophylls preferably zeaxanthin and/or cryptoxanthin produced in the process according to the invention may, however, also be isolated from the plant in the form of their free xanthophylls preferably zeaxanthin and/or cryptoxanthin, lipids, oils and/or fats containing said produced xanthophylls preferably zeaxanthin and/or cryptoxanthin or xanthophylls preferably zeaxanthin and/or cryptoxanthin bound to proteins. Xanthophylls preferably zeaxanthin and/or cryptoxanthin produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

for the disclosure of the paragraphs [0360.0.0.10] to [0362.0.0.10] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the fatty acids produced in the process can be isolated. The resulting xanthophylls can, if appropriate, subsequently be further purified, if desired mixed with other active ingredients such as other xanthophylls, fatty acids, vitamins, amino acids, carbohydrates, antibiotics and the like, and, if appropriate, formulated.

In one embodiment, the xanthophyll is the fine chemical.

The xanthophylls, in particular the respective fine chemicals obtained in the process are suitable as starting material for the synthesis of further products of value. For example, they can be used in combination with each other or alone for the production of pharmaceuticals, health products, foodstuffs, animal feeds, nutrients or cosmetics. Accordingly, the present invention relates a method for the production of pharmaceuticals, health products, food stuff, animal feeds, nutrients or cosmetics comprising the steps of the process according to the invention, including the isolation of the carotenoids containing, in particular xanthophylls containing composition produced or the respective fine chemical produced if desired and formulating the product with a pharmaceutical acceptable carrier or formulating the product in a form acceptable for an application in agriculture. A further embodiment according to the invention is the use of the carentoids or xanthophylls produced in the process or of the transgenic organisms in animal feeds, foodstuffs, medicines, food supplements, cosmetics or pharmaceuticals or for the production of astaxanthin, e.g. in after isolation of the respective fine chemical or without, e.g. in situ, e.g. in the organism used for the process for the production of the respective fine chemical.

for the disclosure of the paragraphs [0366.0.0.10] to [0369.0.0.10] see paragraphs [0366.0.0.0] to [0369.0.0.0] above.

The fermentation broths obtained in this way, containing in particular zeaxanthin and/or beta-cryptoxanthin alone or in mixtures with other carotenoids, in particular with other xanthophylls, e.g. with astaxanthin, or containing microorganisms or parts of microorganisms, like plastids, containing zeaxanthin and/or beta-cryptoxanthin alone or in mixtures with other carotenoids, in particular with other xanthophylls, e.g. with astaxanthin, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

As carotenoids are often localized in membranes or plastids, in one embodiment it is advantageous to avoid a leaching of the cells when the biomass is isolated entirely or partly by separation methods, such as, for example, centrifugation, filtration, decantation, coagulation/flocculation or a combination of these methods, from the fermentation broth. The dry biomass can directly be added to animal feed, provided the carotenoids concentration is sufficiently high and no toxic compounds are present. In view of the instability of carentoids, conditions for drying, e.g. spray or flash-drying, can be mild and can be avoiding oxidation and cis/trans isomerization. For example antioxidants, e.g. BHT, ethoxyquin or other, can be added. In case the carotenoids concentration in the biomass is to dilute, solvent extraction can be used for their isolation, e.g. with alcohols, ether or other organic solvents, e.g. with methanol, ethanol, aceton, alcoholic potassium hydroxide, glycerol-phenol, liquefied phenol or for example with acids or bases, like trichloroacetatic acid or potassium hydroxide. A wide range of advantageous methods and techniques for the isolation of carotenoids, in particular of xanthophylls, in particular of zeaxanthin or cryptoxanthin can be found in the state of the art. In case phenol is used it can for example be removed with ether and water extraction and the dry eluate comprises a mixture of the carotenoids of the biomass.

Accordingly, it is possible to purify the carotenoids, in particular the xanthophylls produced according to the invention further. For this purpose, the product-containing composition, e.g. a total or partial lipid extraction fraction using organic solvents, e.g. as described above, is subjected for example to a saponification to remove triglycerides, partition between e.g. hexane/methanol (separation of non-polar epiphase from more polar hypophasic derivates) and separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.10] to [0376.0.0.10], [0376.1.0.10] and [0377.0.0.10] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 11, columns 5 and 7, preferably in table IB, application no. 11, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.10] to [0383.0.0.10] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 11, column 3, e.g. comparing near identical organisms with low and high activity of the proteins as shown in table II, application no. 11, column 3.

for the disclosure of the paragraphs [0385.0.0.10] to [0404.0.0.10] see paragraphs [0385.0.0.0] to [0404.0.0.0] above.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other carotenoids, in particular the xanthophylls such as astaxanthin or lutein.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorgansms, the plant, plant tissue, plant cell, or the part thereof of the invention, the vector of the invention, the agonist identified with the method of the invention, the antibody of the present invention, can be used for the reduction of the fine chemical in an organism or part thereof, e.g. in a cell.

for the disclosure of the paragraphs [0406.0.0.10] to [0435.0.0.10] see paragraphs [0406.0.0.0] to [0435.0.0.0] above.

Production of xanthophyll, triglycerides, lipids, oils and/or fats containing xanthophylls in *Chlamydomonas reinhardtii*

The xanthophyll production can be analysed as mentioned herein.

The proteins and nucleic acids can be analysed as mentioned below.

forthe disclosure of the paragraphs [0437.0.0.10] and [0438.0.0.10] see paragraphs [0437.0.0.0] and [0438.0.0.0] above.

Example 9

Analysis of the Effect of the Nucleic Acid Molecule on the Production of Xanthophylls The effect of the genetic modification of plants or algae on the production of a desired compound (such as xantopyhlls preferably zeaxanthin and/or cryptoxanthin) can be determined by growing the modified plant under suitable conditions (such as those described above) and analyzing the medium and/or the cellular components for the elevated production of desired product (i.e. of the xanthophylls). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of the Xanthophylls and Determination of the Carotenoids Content:

Abbreviations: GC-MS, gas liquid chromatography/mass spectrometry; TLC, thin-layer chromatography.

The unambiguous detection for the presence of xanthophylls can be obtained by analyzing recombinant organisms using analytical standard methods: LC, LC-MSMS or TLC, as described The total xanthophylls produced in the organism for example in algae used in the inventive process can be analysed for example according to the following procedure:

The material such as algae or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, separation of non-polar epiphase from more polar hypophasic derivatives and chromatography. E.g.:

For analysis, solvent delivery and aliquot removal can be accomplished with a robotic system comprising a single injector valve Gilson 232XL and a 402 2S1V diluter [Gilson, Inc. USA, 3000 W. Beltline Highway, Middleton, Wis.]. For saponification, 3 ml of 50% potassium hydroxide hydro-ethanolic solution (4 water:1 ethanol) can be added to each vial, followed by the addition of 3 ml of octanol. The saponification treatment can be conducted at room temperature with vials maintained on an IKA HS 501 horizontal shaker [Lab-world-online, Inc., Wilmington, N.C.] for fifteen hours at 250 movements/minute, followed by a stationary phase of approximately one hour. Following saponification, the supernatant can be diluted with 0.10 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol: 4 water: 15 tetrahydrofuran (THF) stabilized with 0.2% BHT (2,6-di-tert-butyl-4-methylphenol). Injections were 20 µl. Separation can be isocratic at 30° C. with a flow rate of 1.7 ml/minute. The peak responses can be measured by absorbance at 447 nm.

Carotenoid especially xanthophylls compositions can be determined for wild-type and transgene samples selected from those identified in a screening procedure. Petal samples can be stored in a −80° C. freezer until mutants were identified. Samples can be lyophilized, and the dried tissue can be stored under argon at −80° C. until ready for analysis.

Extraction procedures can be performed under red light. Dried petals can be ground to pass through a No. 40 sieve mesh size. A ground sample can be accurately weighed and transferred into a 100 ml red volumetric flask. To the sample, 500 microliters µl) of $H_2O$ can be added, and the mixture can be swirled for 1 minute. Thirty ml of extractant solvent (10 ml hexane+7 ml acetone+6 ml absolute alcohol+7 ml toluene) can be added, and the flask can be shaken at 160 rpm for 10 minutes.

For saponification, 2 ml of 40% methanolic KOH can be added into the flask, which can be then swirled for one minute. The flask can be placed in a 56° C. $H_2O$ bath for 20 minutes. An air condenser can be attached to prevent loss of solvent. The sample can be cooled in the dark for one hour with the condenser attached. After cooling, 30 ml of hexane can be added, and the flask can be shaken at 160 rpm for 10 minutes.

The shaken sample can be diluted to volume (100 ml) with 10% sodium sulfate solution and shaken vigorously for one minute. The sample can be remained in the dark for at least 30 minutes. A 35 ml aliquot can be removed from the approximately 50 ml upper phase, and transferred to a sample cup. An additional 30 ml of hexane can be added into the flask that can be then shaken at 160 rpm for 10 minutes. After approximately one hour, the upper phases can be combined. For HPLC analysis, 10 ml aliquots can be dried under nitrogen and stored under argon at −80° C.

HPLC equipment comprised an Alliance 2690 equipped with a refrigerated autosampler, column heater and a Waters Photodiode Array 996 detector (Waters Corp., 34 Maple Street Milford, Mass. 01757). Separation can be obtained with a YMC30 column, 3 μm, 2.0×150 mm with a guard column of the same material. Standards can be obtained from ICC Indorespective fine chemicals Somerville, N.J. 088876 and from DHI-Water & Environment, DK-2970 Horsholm, Denmark.

The dried mutant samples can be resuspended in tetrahydrofuran and methanol to a total volume of 200 μl and filtered, whereas the control can be not additionally concentrated. Carotenoids especially xanthophylls can be separated using a gradient method. Initial gradient conditions can be 90% methanol: 5% water: 5% methyl tert-butyl ether at a flow rate of 0.4 milliliters per minute (ml/min). From zero to 15 minutes, the mobile phase can be changed from the initial conditions to 80 methanol: 5 water: 15 methyl tert-butyl ether, and from 15 to 60 minutes to 20 methanol: 5 water: 75 methyl tert-butyl ether. For the following 10 minutes, the mobile phase can be returned to the initial conditions and the column equilibrated for an additional 10 minutes. The column temperature can be maintained at 27° C. and the flow rate was 0.4 ml/minute. Injections were 10 μl. The majority of peak responses can be measured at 450 nm and additional areas added from 286, 348, 400 and 472 nm extracted channels.

If required and desired, further chromatography steps with a suitable resin may follow. Advantageously, the xanthophylls can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

for the disclosure of the paragraphs [0446.0.0.6] to [0496.0.0.6] see paragraphs [0446.0.0.0] to [0496.0.0.0] above.

As an alternative, the xanthopylls can be detected advantageously via HPLC separation in combination with NMR techniques for the structure clarification or in combination with mass spectrometry in case of small sample volumes as described for example by Karsten Putzbach (Theses, 2005 at the Eberhard-Karls-University of Tuebingen, Department of Chemistry and Pharmacy) or Mueller, H. Z. Lebensm. Unters. Forsch. A 204, 1997: 88-94.

The results of the different plant analyses can be seen from the table, which follows:

TABLE VI

| ORF | Metabolite | Method | Min | Max |
|---|---|---|---|---|
| b1095 | Zeaxanthin | LC | 1.25 | 1.37 |
| b2022 | Zeaxanthin | LC | 1.23 | 1.29 |
| b2344 | Zeaxanthin | LC | 1.27 | 1.90 | for the disclosure of the paragraphs [0499.0.0.10] and [0500.0.0.10] see paragraphs [0499.0.0.0] and [0500.0.0.0] above.

Example 15a

Engineering Ryegrass Plants by Over-Expressing b1095 from *Escherichia coli* or Homologs of b1095 from Other Organisms for the disclosure of the paragraphs [0502.0.0.10] to [0508.0.0.10] see paragraphs [0502.0.0.0] to [0508.0.0.0] above.

Example 15b

Engineering Soybean Plants by Over-Expressing b1095 from *Escherichia coli* or Homologs of b1095 from Other Organisms for the disclosure of the paragraphs [0510.0.0.10] to [0513.0.0.10] see paragraphs [0510.0.0.0] to [0513.0.0.0] above.

Example 15c

Engineering Corn Plants by Over-Expressing b1095 from *Escherichia coli* or Homologs of b1095 from Other Organisms for the disclosure of the paragraphs [0515.0.0.10] to [0540.0.0.10] see paragraphs [0515.0.0.0] to [0540.0.0.0] above.

Example 15d

Engineering Wheat Plants by Over-Expressing b1095 from *Escherichia coli* or Homologs of b1095 from Other Organisms for the disclosure of the paragraphs [0542.0.0.10] to [0544.0.0.10] see paragraphs [0542.0.0.0] to [0544.0.0.0] above.

Example 15e

Engineering Rapeseed/Canola Plants by Over-Expressing b1095 from *Escherichia coli* or Homologs of b1095 from Other Organisms for the disclosure of the paragraphs [0546.0.0.10] to [0549.0.0.10] see paragraphs [0544.0.0.0] to [0549.0.0.0] above.

Example 15f

Engineering Alfalfa Plants by Over-Expressing b1095 from *Escherichia coli* or Homologs of b1095 from Other Organisms for the disclosure of the paragraphs [0551.0.0.10] to [0554.0.0.10] see paragraphs [0551.0.0.0] to [0554.0.0.0] above.

% for the disclosure of this paragraph see [0554.2.0.0] above.
for the disclosure of this paragraph see [0555.0.0.0] above.
for the disclosure of this paragraph see [0001.0.0.0].

Carotenoids are red, yellow and orange pigments that are widely distributed in nature. Although specific carotenoids have been identified in photosynthetic centers in plants, in bird feathers, in crustaceans and in marigold petals, they are especially abundant in yellow-orange fruits and vegetables and dark green, leafy vegetables. Of the more than 700 naturally occurring carotenoids identified thus far, as many as 50 may be absorbed and metabolized by the human body. To date, only 14 carotenoids have been identified in human serum.

In animals some carotenoids (particularly beta-carotene) serve as dietary precursors to Vitamin A, and many of them may function as fat-soluble antioxidants. In plants carotenes serve for example as antioxidants to protect the highly reactive photosystems and act as accessory photopigments. In vitro experiments have shown that lycopene, alpha-carotene, zeaxanthin, lutein and cryptoxanthin quench singlet oxygen and inhibit lipid peroxidation. The isolation and identification of oxidized metabolites of lutein, zeaxanthin and lycopene provide direct evidence of the antioxidant action of these carotenoids.

Carotenoids are 40-carbon ($C_{40}$) terpenoids generally comprising eight isoprene ($C_5$) units joined together. Linking of the units is reversed at the center of the molecule. "Keto-carotenoid" is a general term for carotenoid pigments that contain a keto group in the ionene ring portion of the molecule, whereas "hydroxycarotenoid" refers to carotenoid pigments that contain a hydroxyl group in the ionene ring. Trivial names and abbreviations will be used throughout this disclosure, with IUPAC-recommended semisystematic names usually being given in parentheses after first mention of a trivial name. Owing to its three chiral centers, there are $2^3$ or 8 stereoisomers of lutein.

The principal natural stereoisomer of lutein and the form of lutein in the plasma is (3R,3'R,6'R)-lutein, thus a preferred form of the compound. Lutein is also known as xanthophyll (also, the group name of the oxygen-containing carotenoids), vegetable lutein, vegetable luteol and beta, epsilon-carotene-3,3'diol. The molecular formula of lutein is $C_{40}H_{56}O_2$ and its molecular weight is 568.88 daltons. The chemical name of the principal natural stereoisomer of lutein is (3R,3'R,6'R)-beta, epsilon-carotene-3,3'-diol.

Lutein and zeaxanthin esters are hydrolyzed in the small intestine via esterases and lipases. Lutein and zeaxanthin that are derived from supplements or released from the matrices of foods, are either solubilized in the lipid core of micelles (formed from bile salts and dietary lipids) in the lumen of the small intestine, or form clathrate complexes with conjugated bile salts. Micelles and possibly clathrate complexes deliver lutein and zeaxanthin to the enterocytes. Lutein and zeaxanthin are released from the enterocytes into the lymphatics in the form of chylomicrons. They are transported by the lymphatics to the general circulation via the thoracic duct. In the circulation, lipoprotein lipase hydrolyzes much of the triglycerides in the chylomicrons, resulting in the formation of chylomicron remnants. Chylomicron remnants retain apolipoproteins E and B48 on their surfaces and are mainly taken up by the hepatocytes and to a smaller degree by other tissues. Within hepatocytes, lutein and zeaxanthin are incorporated into lipoproteins. Lutein and zeaxanthin appear to be released into the blood mainly in the form of high-density lipoproteins (HDL) and, to a lesser extent, in the form of very-low density lipoprotein (VLDL). Lutein and zeaxanthin are transported in the plasma predominantly in the form of HDL. Lutein and zeaxanthin are mainly accumulated in the macula of the retina, where they bind to the retinal protein tuberlin. Zeaxanthin is specifically concentrated in the macula, especially in the fovea. Lutein is distributed throughout the retina. Zeaxanthin found in plasma is predominantly (3R,3'R)-zeaxanthin. Lutein appears to undergo some metabolism in the retina to meso-zeaxanthin.

Carotenoids are synthesized from a five carbon atom metabolic precursor, isopentenyl pyrophosphate (IPP). There are at least two known biosynthetic pathways in the formation of IPP, the universal isoprene unit. One pathway begins with mevalonic acid, the first specific precursor of terpenoids, formed from acetyl-CoA via HMG-CoA (3-hydroxy-3-methylglutaryl-CoA), that is itself converted to isopentenyl pyrophosphate (IPP). Later, condensation of two geranylgeranyl pyrophosphate (GGPP) molecules with each other produces colorless phytoene, which is the initial carotenoid. Studies have also shown the existence of an alternative, mevalonate-independent pathway for IPP formation that was characterized initially in several species of eubacteria, a green alga, and in the plastids of higher plants. The first reaction in this alternative pathway is the transketolase-type condensation reaction of pyruvate and D-glyceraldehyde-3-phosphate to yield 1-deoxy-D-xylulose-5-phosphate (DXP or DOXP) as an intermediate.

Through a series of desaturation reactions, phytoene is converted to phytofluene, ζ-carotene, neurosporene and finally to lycopene. Subsequently, lycopene is converted by a cyclization reaction to δ-carotene that contains two β-ionene rings. A keto-group and/or a hydroxyl group are introduced into each ring of β-carotene to thereby synthesize canthaxanthin, zeaxanthin, astaxanthin. A hydroxylase enzyme has been shown to convert canthaxanthin to astaxanthin. Similarly, a ketolase enzyme has been shown to convert zeaxanthin to astaxanthin. The ketolase also converts β-carotene to canthaxanthin and the hydroxylase converts β-carotene to zeaxanthin. In many plants, lycopene is a branch point in carotenoid biosynthesis. Thus, some of the plant's lycopene is made into beta-carotene and zeaxanthin, and sometimes zeaxanthin diglucoside, whereas remaining portions of lycopene are formed into alpha-carotene and lutein (3,3'-dihydroxy-α-carotene), another hydroxylated compound.

Lutein and zeaxanthin exist in several forms. Lutein and zeaxanthin also occur in plants in the form of mono- or diesters of fatty acids. For example, lutein and zeaxanthin dipalmitates, dimyristates and monomyristates are found in the petals of the marigold flower (*Tagetes erecta*). Many of the marketed lutein nutritional supplements contain lutein esters, with much smaller amounts of zeaxanthin esters, which are derived from the dried petals of marigold flowers. Lutein dipalmitate is found in the plant *Helenium autumnale* L. Compositae. It is also known as helenien and it is used in France for the treatment of visual disorders. Zeaxanthin in its fatty acid ester forms, is the principal carotenoid found in the plant *Lycium chinese* Mill. *Lycium chinese* Mill, also known as Chinese boxthorn, is used in traditional Chinese medicine for the treatment of a number of disorders, including visual problems. Nutritional supplement forms are comprised of these carotenoids either in their free (non-esterified) forms or in the form of fatty acid esters.

Lutein and zeaxanthin exist in a matrix in foods. In the case of the chicken egg yolk, the matrix is comprised of lipids (cholesterol, phospholipid, triglycerides). The carotenoids are dispersed in the matrix along with fat-soluble nutrients, including vitamins A, D and E. In the case of plants, lutein and zeaxanthin are associated with chloroplasts or chromoplasts.

Carotenoids absorb light in the 400-500 nm region of the visible spectrum. This physical property imparts the characteristic red/yellow colour of the pigments. A conjugated backbone composed of isoprene units is usually inverted at the centre of the molecule, imparting symmetry. Changes in geometrical configuration about the double bonds result in the existence of many cis- and trans-isomers. Hydroxylated, oxidized, hydrogenated or ring-containing derivatives also exist.

Hydrocarbon carotenoids are classified as carotenes while those containing oxygen are known as xanthophylls.

In animals, carotenoids are absorbed from the intestine with the aid of dietary fat and incorporated into chylomicrons for transport in the serum. The different structural features possessed by carotenoids account for selective distribution in organ tissue, biological activity and pro-vitamin A potency, or in vivo conversion to vitamin A. Due to the hydrophobic character, carotenoids are associated with lipid portions of human tissues, cells, and membranes. In general, 80-85% of carotenoids are distributed in adipose tissue, with smaller amounts found in the liver, muscle, adrenal glands, and reproductive organs. Approximately 1% circulate in the serum on high and low density lipoproteins. Serum concentrations are fairly constant and slow to change during periods of low intake. The estimated half-life was estimated to be 11-14 days for lycopene, α-carotene, β-carotene, lutein and zeaxanthin. Evidence for the existence of more than one body pool has been published. The major serum carotenoids are β-carotene, α-carotene, lutein, zeaxanthin, lycopene and cryptoxanthin. Smaller amounts of polyenes such as phytoene and phytofluene are also present.

Human serum levels reflect lifestyle choices and dietary habits within and between cultures. Approximately only 15 carotenoids circulate in the blood, on HDL and LDL. Variations can be attributed to different intakes, unequal abilities to absorb certain carotenoids, and different rates of metabolism and tissue uptake. Decreased serum levels occur with alcohol consumption, the use of oral contraceptives, smoking and prolonged exposure to UV light.

The established efficacy of lutein in quenching singlet oxygen and intercepting deleterious free radicals and reactive oxygen species can make it part of the diverse antioxidant defense system in humans. Reactive oxygen species have been implicated in the development of many diseases, including ischemic heart disease, various cancers, cataracts and macular degeneration. Because the conjugated polyene portion of beta-carotene confers its antioxidant capability and all carotenoids possess this structural feature, research efforts have been directed at evaluating the efficacy of other carotenoids in the prevention of free radical-mediated diseases. Indeed, in vitro experiments have demonstrated that lycopene, alpha-carotene, zeaxanthin, lutein and cryptoxanthin quench singlet oxygen and inhibit lipid peroxidation. The isolation and identification of oxidized metabolites of lutein, zeaxanthin and lycopene may provide direct evidence of the antioxidant action of these carotenoids.

In addition to antioxidant capability, other biological actions of carotenoids include the ability to enhance immunocompetence and in vitro gap junction communication, reduce or inhibited mutagenesis and inhibit cell transformations in vitro.

Many epidemiological studies have established an inverse correlation between dietary intake of yellow-orange fruit and dark green, leafy vegetables and the incidence of various cancers, especially those of the mouth, pharynx, larynx, esophagus, lung, stomach, cervix and bladder. While a number of protective compounds may be responsible for this observation, the co-incidence of carotenoids in these foods has been noted. Because nutritionists and medical professionals currently recognize the occurrence of a large number of distinct carotenoids in food, interest in their functions and biological impact on health is burgeoning.

Lutein exists in the retina. It functions to protect photoreceptor cells from lightgenerated oxygen radicals, and thus plays a key role in preventing advanced macular degeneration. Lutein possesses chemopreventive activity, induces gap junction communication between cells and inhibits lipid peroxidation in vitro more effectively than beta-carotene, alpha-carotene and lycopene. High levels of lutein in serum have been inversely correlated with lung cancer.

In addition to lutein, zeaxanthin exists in the retina and confers protection against macular degeneration. Zeaxanthin is also prevalent in ovaries and adipocyte tissue. This xanthophyll does not possess provitamin A activity.

Alcohol consumption has been shown to influence lipid peroxidation. Anhydrolutein, an oxidative by-product of lutein and zeaxanthin, was higher in plasma after alcohol ingestion, while concentrations of these xanthophylls were reduced. Lutein and zeaxanthin may therefore have protective effects against LDL oxidation.

In plants, approximately 80-90% of the carotenoids present in green, leafy vegetables such as broccoli, kale, spinach and brussel sprouts are xanthophylls, whereas 10-20% are carotenes. Conversely, yellow and orange vegetables including carrots, sweet potatoes and squash contain predominantly carotenes. Up to 60% of the xanthophylls and 15% of the carotenes in these foods are destroyed during microwave cooking. Of the xanthophylls, lutein appears to be the most stable.

Lutein occurs in mango, papaya, oranges, kiwi, peaches, squash, peas, lima beans, green beans, broccoli, brussel sprouts, cabbage, kale, lettuce, prunes, pumpkin, sweet potatoes and honeydew melon. Commercial sources are obtained from the extraction of marigold petals. Lutein does not possess provitamin A activity.

Dietary sources of Zeaxanthin include peaches, squash, apricots, oranges, papaya, prunes, pumpkin, mango, kale, kiwi, lettuce, honeydew melon and yellow corn.

Some carotenoids occur particularly in a wide variety of marine animals including fish such as salmonids and sea bream, and crustaceans such as crab, lobster, and shrimp. Because animals generally cannot biosynthesize carotenoids, they obtain those carotenoids present in microorganisms or plants upon which they feed.

Carotenoids, e.g. xanthophylls, in particular lutein, supplied from biological sources, such as crustaceans, yeast, and green alga is limited by low yield and costly extraction methods when compared with that obtained by organic synthetic methods. Synthetic methods are e.g. described in Hansgeorg Ernst, *Pure Appl. Chem.*, Vol. 74, No. 8, pp. 1369-1382, 2002. Usual synthetic methods, however, produce by-products that can be considered unacceptable. It is therefore desirable to find a relatively inexpensive source of carotenoids, in particular lutein, to be used as a feed supplement in aquaculture and as a valuable chemical for other industrial uses and for diets. Sources of xanthophylls include crustaceans such as a krill in the Antarctic Ocean, cultured products of the yeast *Phaffia*, cultured products of a green alga *Haematococcus pluvialis*, and products obtained by organic synthetic methods. However, when crustaceans such as a krill or the like are used, a great deal of work and expense are required for the isolation of xanthophylls from contaminants such as lipids and the like during the harvesting and extraction. Moreover, in the case of the cultured product of the yeast *Phaffia*, a great deal of expense is required for the gathering and extraction of astaxanthin because the yeast has rigid cell walls and produces xanthophylls only in a low yield. One approach to increase the productivity of some xanthophylls' production in a biological system is to use genetic engineering technology.

Carotenoids in higher plants; i.e., angiosperms, are found in plastids; i.e., chloroplasts and chromoplasts. Plastids are intracellular storage bodies that differ from vacuoles in being surrounded by a double membrane rather than a single membrane. Plastids such as chloroplasts can also contain their own DNA and ribosomes, can reproduce independently, and synthesize some of their own proteins. Plastids thus share several characteristics of mitochondria. In leaves, carotenoids are usually present in the grana of chloroplasts where they provide a photoprotective function. Betacarotene and lutein are the predominant carotenoids, with the epoxidized carotenoids violaxanthin and neoxanthin being present in smaller amounts. Carotenoids accumulate in developing chromoplasts of flower petals, usually with the disappearance of chlorophyll. As in flower petals, carotenoids appear in fruit chromoplasts as they develop from chloroplasts. Most enzymes that take part in conversion of phytoene to carotenes and xanthophylls are labile, membrane-associated proteins that lose activity upon solubilization. In maize, cartonoids were present in horny endosperm (74% to 86%), floury endosperm (9%-23%) and in the germ and bran of the kernel.

At the present time only a few plants are widely used for commercial coloured carotenoid production. However, the productivity of coloured carotenoid synthesis in most of these plants is relatively low and the resulting carotenoids are expensively produced.

Dried marigold petals and marigold petal concentrates obtained from so-called xanthophyll marigolds are used as feed additives in the poultry industry to intensify the yellow color of egg yolks and broiler skin. The pigmenting ability of marigold petal meal resides largely in the carotenoid fraction known as the xanthophylls, primarily lutein esters. The xanthophyll zeaxanthin, also found in marigold petals, has been shown to be effective as a broiler pigmenter, producing a highly acceptable yellow to yellow-orange color. Of the xanthophylls, the pigments lutein and zeaxanthin are the most abundant in commercially available hybrids.

Carotenoids have been found in various higher plants in storage organs and in flower petals. For example, marigold flower petals accumulate large quantities of esterified lutein as their predominant xanthophyll carotenoid (about 75 to more than 90 percent), with smaller amounts of esterified zeaxanthin. Besides lutein and zeaxanthin, marigold flower petals also typically exhibit a small accumulation of β-carotene and epoxidized xanthophylls, but do not produce or accumulate canthaxanthin or astaxanthin because a 4-keto-β-ionene ring-forming enzyme is absent in naturally-occurring marigolds or their hybrids.

One way to increase the productive capacity of biosynthesis is to apply recombinant DNA technology. Thus, it would be desirable to produce coloured carotenoids generally and, with the use of recent advances in determining carotenoid biosynthesis from β-carotene to xanthophylls to control the production of carotenoids. That type of production permits control over quality, quantity, and selection of the most suitable and efficient producer organisms. The latter is especially important for commercial production economics and therefore availability to consumers.

Methods of recombinant DNA technology have been used for some years to improve the production of Xanthophylls in microorganisms, in particular algae or in plants by amplifying individual xanthophyll biosynthesis genes and investigating the effect on xanthophyll production. It is for example reported, that the five ketocarotenoids, e.g. the xanthophyll astaxanthin could be produced in the nectaries of transgenic tobacco plants. Those transgenic plants were prepared by *Argobacterium tumifaciens*-mediated transformation of tobacco plants using a vector that contained a ketolase-encoding gene from *H. pluvialis* denominated crtO along with the Pds gene from tomato as the promoter and to encode a leader sequence. The Pds gene was said by those workers to direct transcription and expression in chloroplasts and/or chromoplast-containing tissues of plants. Those results indicated that about 75 percent of the carotenoids found in the flower of the transformed plant contained a keto group. Further, in maize the phytonene synthase (Psy), Phytone desaturase (Pds), and the ζ-carotene desaturase were identified and it was shown, that PSY activity is an important control point for the regulation of the flux.

Genes suitable for conversion of microorganisms have also been reported (U.S. Pat. No. 6,150,130 WO 99/61652). Two different genes that can convert a carotenoid β-ionene ring compound into astaxanthin have been isolated from the green alga *Haematococcus pluvialis*. Zeaxanthin or β-carotene were also found in the marine bacteria *Agrobacterium aurantiacum, Alcaligenes* PC-1, *Erwinia uredovora*. An *A. aurantiacum* crtZ gene was introduced to an *E. coli* transformant that accumulated all-trans-β-carotene. The transformant so formed produced zeaxanthin. A gene cluster encoding the enzymes for a carotenoid biosynthesis pathway has been also cloned from the purple photosynthetic bacterium *Rhodobacter capsulatus*. A similar cluster for carotenoid biosynthesis from ubiquitous precursors such as farnesyl pyrophosphate and geranyl pyrophosphate has been cloned from the non-photosynthetic bacteria *Erwinia herbicola*. Yet another carotenoid biosynthesis gene cluster has been cloned from *Erwinia uredovora*. It is yet unknown and unpredictable as to whether enzymes encoded by other organisms behave similarly to that of *A. aurantiacum* in vitro or in vivo after transformation into the cells of a higher plant.

Thus, it would be advantageous if an algae or other microorganism were available which produce large amounts of β-carotene, beta-cryptoxanthin, lutein, zeaxanthin, or other carotenoids. The invention discussed hereinafter relates in some embodiments to such transformed prokaryotic or eukaryotic microorganisms.

It would also be advantageous if a marigold or other plants were available whose flowers produced large amounts of β-carotene, beta-cryptoxanthin, lutein, zeaxanthin, or other carotenoids. The invention discussed hereinafter relates in some embodiments to such transformed plants.

Therefore improving the quality of foodstuffs and animal feeds is an important task of the food-and-feed industry. This is necessary since, for example, as mentioned above xanthophylls, which occur in plants and some microorganisms are limited with regard to the supply of mammals. Especially advantageous for the quality of foodstuffs and animal feeds is as balanced as possible a carotenoids profile in the diet since a great excess of some carotenoids above a specific concentration in the food has only some positive effect. A further increase in quality is only possible via addition of further carotenoids, which are limiting.

To ensure a high quality of foods and animal feeds, it is therefore necessary to add carotenoidsin a balanced manner to suit the organism.

Accordingly, there is still a great demand for new and more suitable genes which encode proteins or regulators which participate in the biosynthesis of lutein and make it possible to produce lutein and other carotenoids specifically on an industrial scale without unwanted byproducts forming. In the selection of genes for or regulators of biosynthesis two characteristics above all are particularly important. On the one hand, there is as ever a need for improved processes for obtaining the highest possible contents of carotenoids like lutein on the other hand as less as possible byproducts should be produced in the production process.

for the disclosure of this paragraph see [0013.0.0.0] above. [0014.0.11.11] Accordingly, in a first embodiment, in context of paragraphs [0001.n.n.11] to [0555.n.n.11] the invention relates to a process for the production of a fine chemical, whereby the fine chemical is lutein. Accordingly, in the present invention, the term "the fine chemical" as used herein relates to "lutein". Further, the term "the fine chemicals" as used herein also relates to fine chemicals comprising lutein.

In one embodiment, in context with paragraphs [0001.n.n.11] to means lutein. Throughout the specification of paragraph [0001.n.n.11] to paragraph [0555.n.n.11] the term "the respective fine chemical" or the term "lutein" means lutein in its free form, its salts, ester, its mono- or diesters of fatty acids, e.g. as lutein dipalmitates, dimyristates or mono-myristates or bound to proteins, e.g. lipoproteins or tuberlin, or bound to other compounds.

Lutein exist in a matrix in foods. Thus, in one embodiment, the fine chemical produced according to the process of the invention is a matrix comprising inter alia lipids, in particular cholesterol, phospholipid, and/or triglycerides, and lutein.

Thus in one embodiment, the fine chemical is a lutein ester. In one particular embodiment, the fine chemical is a lutein ester of a natural occurring, preferably in plants or microorganisms occurring fatty acid. In a further embodiment, the fine chemical is a lutein monoester. In a further embodiment, the fine chemical is a lutein diester. In a further embodiment, the fine chemical is lutein dipalmitates, dimyristates or mono-myristates. In a further embodiment, the fine chemical is a lutein comprising matrix. In a further embodiment, the fine chemical is a lutein comprising micelle, e.g. a micelle formed from bile salts or dietary lipids, or a clathrate complex, e.g. with conjugated bile salts. In a further embodiment, the fine chemical is lutein in the form of chylomicrons. In a further embodiment, the fine chemical is lutein in the form of chylomicron remnants. In a further embodiment, the fine chemical is lutein incorporated into lipoproteins, e.g. HDL or VLDL. In a further embodiment, the fine chemical is lutein bound to tuberlin. In a further embodiment, the fine chemical is free lutein, in particular (3R,3'R,6'R)-lutein.

Accordingly, the present invention relates to a process for the production of lutein, which comprises (a) increasing or generating the activity of a protein as shown in table II, application no. 12, column 3 encoded by the nucleic acid sequences as shown in table I, application no. 12, column 5, in an organelle of a microorganism or plant, or (b) increasing or generating the activity of a protein as shown in table II, application no. 12, column 3 encoded by the nucleic acid sequences as shown in table I, application no. 12, column 5 in the plastid of a microorganism or plant, or in one or more parts thereof; and (c) growing the organism under conditions which permit the production of the fine chemical, thus, lutein or fine chemicals comprising lutein, in said organism or in the culture medium surrounding the organism.

Accordingly, the term "the fine chemical" means in one embodiment "lutein" in relation to all sequences listed in Table I to IV, application No. 12

In another embodiment the present invention is related to a process for the production of lutein, which comprises (a) increasing or generating the activity of a protein as shown in table II, application no. 12 column 3 encoded by the nucleic acid sequences as shown in table I, application no. 12, column 5, in an organelle of a non-human organism, or (b) increasing or generating the activity of a protein as shown in table II, application no. 12, column 3 encoded by the nucleic acid sequences as shown in table I, application no. 12, column 5, which are joined to a nucleic acid sequence encoding a transit peptide in a non-human organism, or in one or more parts thereof; or (c) increasing or generating the activity of a protein as shown in table II, application no. 12, column 3 encoded by the nucleic acid sequences as shown in table I, application no. 12, column 5, which are joined to a nucleic acid sequence encoding chloroplast localization sequence, in a non-human organism, or in one or more parts thereof, and (d) growing the organism under conditions which permit the production of lutein in said organism.

In another embodiment, the present invention relates to a process for the production of lutein, which comprises (a) increasing or generating the activity of a protein as shown in table II, application no. 12, column 3 encoded by the nucleic acid sequences as shown in table I, application no. 12, column 5, in an organelle of a microorganism or plant through the transformation of the organelle, or (b) increasing or generating the activity of a protein as shown in table II, application no. 12, column 3 encoded by the nucleic acid sequences as shown in table I, application no. 12, column 5 in the plastid of a microorganism or plant, or in one or more parts thereof through the transformation of the plastids; and (c) growing the organism under conditions which permit the production of the fine chemical, thus, lutein or fine chemicals comprising lutein, in said organism or in the culture medium surrounding the organism.

Advantagously the activity of the protein as shown in table II, application no. 12, column 3 encoded by the nucleic acid sequences as shown in table I, application no. 12, column 5 is increased or generated in the abovementioned process in the plastid of a microorganism or plant.

for the disclosure of the paragraphs [0019.0.0.11] to [0024.0.0.11] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 12, columns 5 and 7. Most preferred nucleic acid sequences encoding transit peptides are derived from the genus *Spinacia* such as chloroplast 30S ribosomal protein PSrp-1, root acyl carrier protein 11, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 12, column 3 and its homologs as disclosed in table I, application no. 12, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 12, column 3 and its homologs as disclosed in table I, application no. 12, columns 5 and 7.

for the disclosure of the paragraphs [0027.0.0.11] to [0029.0.0.11] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 12, columns 5 and 7. The person skilled in the art is able to join said sequences in a functional manner. Advantageously the transit peptide part is cleaved off from the protein part shown in table II, application no. 12, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 12, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 12, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 12, columns 5 and 7. Furthermore the skilled worker is aware of the fact that there is not a need for such short sequences in the expression of the genes.

Table V: Examples of transit peptides disclosed by von Heijne et al.: for the disclosure of the Table V see paragraphs [0030.2.0.0] above.

Alternatively to the targeting of the sequences shown in table II, application no. 12, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 12, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.11] and [0030.3.0.11] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 12, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 12, columns 5 and 7 or a sequence encoding a protein, as depicted in table II, application no. 12, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table, 1, application no. 12, columns 5 and 7 or a sequence encoding a protein, as depicted in table II, application no. 12, columns 5 and 7 in such a manner that the viroid sequence transports a sequence transcribed from a sequence as depicted in table 1 application no. 12, columns 5 and 7 or a sequence encoding a protein as depicted in table II, application no. 12, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 12, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 12, columns 5 and 7.

In a preferred embodiment of the invention the nucleic acid sequences as shown in table I, application no. 12, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 12, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.11] and [0032.0.0.11] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 12, column 3. Preferably the modification of the activity of a protein as shown in table II, application no. 12, column 3 or their combination can be achieved by joining the protein to a transit peptide.

Surprisingly it was found, that the transgenic expression of the *E. coli* proteins shown in table II, application no. 12, column 3 in plastids of a plant such as *Arabidopsis thaliana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *E. coli* protein b2344 in combination with a plastidal targeting sequence in *Arabidopsis thaliana* conferred an increase in lutein.

for the disclosure of this paragraph see paragraph [0035.0.0.0] above.

The sequence of b2344 (Accession number PIR:F65007) from *Escherichia coli* has been published in Blattner et al., Science 277 (5331), 1453-1474 (1997), and its activity is being defined as "outer membrane porin, transport of long-chain fatty acids, sensitivity to phage T2". Accordingly, in one embodiment, the process of the present invention comprises the use of a "outer membrane porin, transport of long-chain fatty acids, sensitivity to phage T2" or its homolog, e.g. as shown herein, for the production of the fine chemical, meaning of lutein, in particular for increasing the amount of lutein in free or bound form in an organism or a part thereof, as mentioned. In one embodiment, in the process of the present invention the activity of a b2344 protein is increased or generated, e.g. from *Escherichia coli* or a homolog thereof, preferably linked at least to one transit peptide as mentioned for example in table V. In another embodiment, in the process of the present invention the activity of a b2344 protein is increased or generated in a subcellular compartment of the organism or organism cell such as in an organelle like a plastid or mitochondria.

In one embodiment, the homolog of the b2344 is a homolog having said activity and being derived from bacteria. In one embodiment, the homolog of the b2344 is a homolog having said activity and being derived from Proteobacteria. In one embodiment, the homolog of the b2344 is a homolog having said activity and being derived from Gammaproteobacteria. In one embodiment, the homolog of the b2344 is a homolog having said activity and being derived from Enterobacteriales. In one embodiment, the homolog of the b2344 is a homolog having said activity and being derived from Enterobacteriaceae. In one embodiment, the homolog of the b2344 is a homolog having said activity and being derived from *Escherichia*, preferably from *Escherichia coli*.

Homologs of the polypeptide disclosed in table II, application no. 12, column 3 may be the polypeptides encoded by the nucleic acid molecules indicated in table I, application no. 12, column 7, resp., or may be the polypeptides indicated in table II, application no. 12, column 7, resp.

for the disclosure of this paragraph see paragraph [0038.0.0.0] above.

In accordance with the invention, a protein or polypeptide has the "activity of an protein as shown in table II, application no. 12, column 3" if its de novo activity, or its increased expression directly or indirectly leads to an increased in the level of the fine chemical indicated in the respective line of table II, application no. 12, column 6 "metabolite" in the organism or a part thereof, preferably in a cell of said organism, more preferably in an organelle such as a plastid or mitochondria of said organism. The protein has the above mentioned activities of a protein as shown in table II, application no. 12, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 12, column 3, or which has at least 10% of the original enzymatic activity, preferably 20%, particularly preferably 30%, most particularly preferably 40% in comparison to a protein as shown in the respective line of table II, application no. 12, column 3 of E. coli.

for the disclosure of the paragraphs [0040.0.0.11] to [0047.0.0.11] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 12, column 3 its biochemical or genetical causes and the increased amount of the respective fine chemical.

for the disclosure of the paragraphs [0049.0.0.11] to [0051.0.0.11] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 12, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.11] to [0058.0.0.11] see paragraphs [0053.0.0.0] to [0058.0.0.0] above.

In case the activity of the Escherichia coli protein b2344 or its homologs, e.g. a "outer membrane porin, transport of long-chain fatty acids, sensitivity to phage T2" is increased, advantageously in an organelle such as a plastid or mitochondria, preferably, an increase of the fine chemical, preferably of free lutein between 39% and 115% or more is conferred.

In one embodiment, the activity of the Escherichia coli protein b2344 or its homologs, e.g. a outer membrane porin, transport of long-chain fatty acids, sensitivity to phage T2" is advantageously increased in an organelle such as a plastid or mitochondria, preferably conferring an increase of the fine chemical indicated in column 6 "metabolites" for application no. 12 in any one of Tables I to IV and of further carotenoids, preferably xanthophylls, in particular zeaxanthin.

for the disclosure of the paragraphs [0061.0.0.11] and [0062.0.0.11] see paragraphs [0061.0.0.0] and [0062.0.0.0] above.

A protein having an activity conferring an increase in the amount or level of the fine chemical, preferably upon targeting to the plastids, has in one embodiment the structure of the polypeptide described herein, in particular of the polypeptides comprising the consensus sequence shown in table IV, application no. 12, column 7 or of the polypeptide as shown in the amino acid sequences as disclosed in table II, application no. 12, columns 5 and 7 or the functional homologues thereof as described herein, or is encoded by the nucleic acid molecule characterized herein or the nucleic acid molecule according to the invention, for example by the nucleic acid molecule as shown in table I, application no. 12, columns 5 and 7 or its herein described functional homologues and has the herein mentioned activity.

For the purposes of the present invention, the reference to the fine chemical, e.g. to the term "lutein", also encompasses the corresponding salt, ester, e.g. the mono- or diesters of fatty acids, e.g. lutein dipalmitates, dimyristates or monomyristates, or lutein bound to proteins, e.g. lipoproteins or e.g. tuberlin, or bound to other compounds.

Lutein exist in a matrix in foods. Thus, in one embodiment, the fine chemical produced according to the process of the invention is a matrix comprising inter alia lipids, in particular cholesterol, phospholipid, and/or triglycerides, and lutein.

for the disclosure of the paragraphs [0065.0.0.11] and [0066.0.0.11] see paragraphs [0065.0.0.0] and [0066.0.0.0] above.

In one embodiment, the process of the present invention comprises one or more of the following steps
a) stabilizing a protein conferring the increased expression of a protein encoded by the nucleic acid molecule of the invention or of the polypeptide of the invention, e.g. of a polypeptide having the activity of a protein as indicated in table II, application no. 12, columns 5 and 7 or its homologs activity having herein-mentioned lutein increasing activity; and/or
b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 12, columns 5 and 7, e.g. a nucleic acid sequence encoding a polypeptide having the activity of a protein as indicated in table II, application no. 12, columns 5 and 7 or its homologs activity or of a mRNA encoding the polypeptide of the present invention having herein-mentioned lutein increasing activity; and/or
c) increasing the specific activity of a protein conferring the increased expression of a protein encoded by the nucleic acid molecule of the invention or of the polypeptide of the present invention having herein-mentioned lutein increasing activity, e.g. of a polypeptide having the activity of a protein as indicated in table II, application no. 12, columns 5 and 7 or its homologs activity, or decreasing the inhibitory regulation of the polypeptide of the invention; and/or
d) generating or increasing the expression of an endogenous or artificial transcription factor mediating the expression of a protein conferring the increased expression of a protein encoded by the nucleic acid molecule of the invention or of the polypeptide of the invention having herein-mentioned lutein increasing activity, e.g. of a polypeptide having the activity of a protein as indicated in table II, application no. 12, columns 5 and 7 or its homologs activity; and/or e) stimulating activity of a protein conferring the increased expression of a protein encoded by the nucleic acid molecule of the present invention or a polypeptide of the present invention having herein-mentioned lutein increasing activity, e.g. of a polypeptide having the activity of a protein as indicated in table II, application no. 12, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned lutein increasing activity, e.g. of a polypeptide having the activity of a protein as indicated in table II, application no. 12, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned lutein increasing activity, e.g. of a polypeptide having the activity of a protein as indicated in table II, application no. 12, columns 5 and 7 or its homologs activity; and/or h) increasing the expression of the endogenous gene encoding the polypeptide of the invention, e.g. a polypeptide having the activity of a protein as indicated in table II, application no. 12, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned lutein increasing activity, e.g. of polypeptide having the activity of a protein as indicated in table II, application no. 12, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned lutein increasing activity, e.g. of a polypeptide having the activity of a protein as indicated in table II, application no. 12, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned lutein increasing activity, e.g. of a polypeptide having the activity of a protein as indicated in table II, application no. 12, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the respective fine chemical as indicated in column 6 of application no. 12 in Table I to IV, resp., after increasing the expression or activity of the encoded polypeptide preferably in organelles such as plastids or having the activity of a polypeptide having an activity as the protein as shown in table II, application no. 12, column 3 or its homologs. Preferably the increase of the fine chemical takes place in plastids.

for the disclosure of the paragraphs [0069.0.0.11] to [0079.0.0.11] see paragraphs [0069.0.0.0] to [0079.0.0.0] above.

The activation of an endogenous polypeptide having above-mentioned activity, e.g. having the activity of a protein as shown in table II, application no. 12, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 12, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 12, column 3. The expression of the chimeric transcription factor in a organism, in particular in a plant, leads to a specific expression of the protein as shown in table II, application no. 12, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.11] to [0084.0.0.11] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous lutein containing composition comprising a higher content of (from a viewpoint of nutritional physiology limited), carotenoids, e.g. xanthophylls, in particular lutein, e.g. in combination with fatty acid(s), dietary oil(s), such as corn oil, and/or triglycerides, in particular medium-chain (e.g. $C_4$ to $C_{18}$—, in particular $C_6$ to $C_{14}$—) triglycerides, lipoproteins, e.g. HDL and/or VLDL, micelles, clathrate complexes, e.g. conjugated with bile salts, chylomicrons, chylomicron remnants, tuberlin and/or other carotenoids, e.g. xanthophylls, in particular zeaxanthin It can also be advantageous to increase the level of a metabolic precursor of lutein in the organism or part thereof, e.g. of phytoene, lycopene, alpha-carotene. It can also be advantageous owing to the introduction of a gene or a plurality of genes conferring the expression of a inhibitory nucleic acid molecule, e.g. for a gene k.o., e.g. a iRNA or a antisense nucleic acid, to decrease the level of production of neoxanthin or one or more precursor thereof, e.g. vialastaxanthin, zeaxanthin, and/or beta-carotene as this might increase the level of lycopene to be provided for the production of lutein according to method of present invention.

Depending on the choice of the organism used for the process according to the present invention, for example a microorganism or a plant, compositions or mixtures of various carotenoids and lutein can be produced.

for the disclosure of this paragraph see paragraph [0086.0.0.0] above.

By influencing the metabolism thus, it is possible to produce, in the process according to the invention, further advantageous compounds. Examples of such compounds are are further carotenoids, e.g. carotenes or xanthophylls, in particular ketocarotenoids, or hydrocarotenoids, e.g. beta-cryptoxanthin, zeaxanthin, astaxanthin, lycopene, alpha-carotene, or beta-carentene, or compounds for which lutein is a precursor compound or medium-chain (e.g $C_4$ to $C_{18}$—, in particular $C_6$ to $C_{14}$—) triglycerides, lipoproteins, e.g. HDL and/or VLDL, micelles, clathrate complexes, e.g. conjugated with bile salts, chylomicrons, chylomicron remnants, and/or tuberlin.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 12, column 3 or of a polypeptide being encoded by the nucleic acid molecule of the present invention and described below, e.g. conferring an increase of the respective fine chemical as indicated in any one of Tables I to IV, application no. 12, column 6 "metabolite" in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and
d) if desired, recovering, optionally isolating, the respective free and/or bound the fine chemical as indicated in any one of Tables I to IV, application no. 12, column 6 "metabolite" and, optionally further free and/or bound carotenoids, in particular ketocarotenoids, or hydrocarotenoids, e.g. beta-cryptoxanthin, zeaxanthin, astaxanthin, lycopene, alpha-carotene, or beta-carotene, synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the respective fine chemical but as option it is also possible to produce, recover and, if desired isolate, other free or/and bound carotenoids, in particular ketocarotenoids, or hydrocarotenoids, e.g. beta-cryptoxanthin, zeaxanthin, astaxanthin, lycopene, alpha-carotene, or beta-carotene.

for the disclosure of the paragraphs [0090.0.0.11] to [0097.0.0.11] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods,preferably in which either
a) the nucleic acid sequence as shown in table I, application no. 12, columns 5 and 7 or a derivative thereof, or
b) a genetic regulatory element, for example a promoter, which is functionally linked to the nucleic acid sequence as shown table I, application no. 12, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 12, columns 5 and 7 joined to a nucleic acid sequence encoding a transit peptide, or a targeting nucleic acid sequence which directs the nucleic acid sequences disclosed in table I, application no. 12, columns 5 and 7 to the organelle preferentially the plastids. Altenatively the inventive nucleic acids sequences consist advantageously of the nucleic acid sequences as depicted in the sequence protocol and disclosed in table I, application no. 12, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose lutein content is modified advantageously owing to the nucleic acid molecule of the present invention expressed. This is important for plant breeders since, for example, the nutritional value of plants for poultry is dependent on the abovementioned lutein as antioxidant source in feed. Further, this is also important for the production of cosmetic compostions since, for example, the antioxidant level of plant extracts is depending on the abovementioned lutein and the general amount of antioxidants e.g. as vitamins.

After the activity of the protein as shown in table II, application no. 12, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.11] to [0110.0.0.11] see paragraphs [0102.0.0.0] to [0110.0.0.0] above.

In a preferred embodiment, the respective fine chemical as indicated in any one of Tables I to IV, application no. 12, column 6 "metabolite" (lutein) is produced in accordance with the invention and, if desired, is isolated. The production of further vitamins, provitamins or carotenoids, e.g. carotenes or xanthophylls, or mixtures thereof or mixtures with other compounds by the process according to the invention is advantageous.

Thus, the content of plant components and preferably also further impurities is as low as possible, and the abovementioned lutein are obtained in as pure form as possible. In these applications, the content of plant components advantageously amounts to less than 10%, preferably 1%, more preferably 0.1%, very especially preferably 0.01% or less.

In another preferred embodiment of the invention a combination of the increased expression of the nucleic acid sequence or the protein of the invention together with the transformation of a protein or polypeptide or a compound, which functions as a sink for the desired fine chemical, for example lutein in the organism, is useful to increase the production of the respective fine chemical (as indicated in any one of Tables I to IV, application no. 12, column 6 "metabolite").

In the case of the fermentation of microorganisms, the above-mentioned lutein may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, spray granulation or by other methods. Preferably the respective fine chemical as indicated for application no. 12 in any one of Tables I to IV, column 6 "metabolite" or the lutein comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the lutein, synthesized in the process according to the invention can advantageously be marketed directly without there being any need for lutein synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

The site of lutein biosynthesis in plants is, inter alia, the leaf tissue so that the isolation of leafs makes sense. However, this is not limiting, since the expression may also take place in a tissue-specific manner in all of the remaining parts of the plant, in particular in fat-containing seeds. A further preferred embodiment therefore relates to a seed-specific isolation of lutein.

However, the respective fine chemical as indicated for application no. 12 in any one of Tables I to IV, column 6, "metabolite" produced in the process according to the invention can also be isolated from the organisms, advantageously plants, in the form of their oils, fats, lipids as extracts, e.g. ether, alcohol, or other organic solvents or water containing extract and/or free lutein. The respective fine chemical produced by this process can be obtained by harvesting the organisms, either from the crop in which they grow, or from the field. This can be done via pressing or extraction of the plant parts, preferably the plant seeds. To increase the efficiency of oil extraction it is beneficial to clean, to temper and if necessary to hull and to flake the plant material especially the seeds. e.g. the oils, fats, lipids, extracts, e.g. ether, alcohol, or other organic solvents or water containing extract and/or free lutein can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as preferably warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid.

Because lutein in microorganisms may be localized intracellularly, their recovery essentials comes down to the isolation of the biomass. Well-established approaches for the harvesting of cells include filtration, centrifugation and coagulation/flocculation as described herein.

Lutein can for example be analyzed advantageously via HPLC, LC or GC separation methods and detected by MS order MSMS methods. The unambiguous detection for the presence of Lutein containing products can be obtained by analyzing recombinant organisms using analytical standard methods: GC, GC-MS, or TLC, as described on several occasions by Christie and the references therein (1997, in:

Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). The material to be analyzed can be disrupted by sonication, grinding in a glass mill, liquid nitrogen and grinding, cooking, or via other applicable methods; see also Biotechnology of Vitamins, Pigments and Growth Factors, Edited by Erik J. Vandamme, London, 1989, p. 96 to 103.

In a preferred embodiment, the present invention relates to a process for the production of the respective fine chemical as indicated for application no. 12 in any one of Tables I to IV, column 6 "metabolite", comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 12, columns 5 and 7 or a fragment thereof, which confers an increase in the amount of the respective fine chemical in an organism or a part thereof;

b) nucleic acid molecule comprising, preferably at least the mature form, of the nucleic acid molecule shown in table I, application no. 12, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybidizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;

h) nucleic acid molecule comprising a nucleic acid molecule which is obtained by amplifying nucleic acid molecules from a cDNA library or a genomic library using the primers shown in table III, application no. 12, column 7 and conferring an increase in the amount of the respective fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;

j) nucleic acid molecule which encodes a polypeptide comprising the consensus sequence shown in table IV, application no. 12, column 7 and conferring an increase in the amount of the respective fine chemical in an organism or a part thereof;

k) nucleic acid molecule comprising one or more of the nucleic acid molecule encoding the amino acid sequence of a polypeptide encoding a domain of the polypeptide shown in table II, application no. 12, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in table IA, application no. 12, columns 5 and 7 by one or more nucleotides. In one embodiment, the nucleic acid molecule used in the process of the invention does not consist of the sequence indicated in table IA, application no. 12, columns 5 and 7. In one embodiment, the nucleic acid molecule used in the process of the invention is less than 100%, 99.999%, 99.99%, 99.9% or 99% identical to a sequence indicated in table IA, application no. 12, columns 5 and 7. In another embodiment, the nucleic acid molecule does not encode a polypeptide of a sequence indicated in table IIA, application no. 12, columns 5 and 7.

In one embodiment, the nucleic acid molecule used in the process of the invention distinguishes over the sequence indicated in table IB, application no. 12, columns 5 and 7, by one or more nucleotides. In one embodiment, the nucleic acid molecule used in the process of the invention does not consist of the sequence indicated in table IB, application no. 12, columns 5 and 7. In one embodiment, the nucleic acid molecule used in the process of the invention is less than 100%, 99.999%, 99.99%, 99.9% or 99% identical to a sequence indicated in table IB, application no. 12, columns 5 and 7. In another embodiment, the nucleic acid molecule does not encode a polypeptide of a sequence indicated in table IIB, application no. 12, columns 5 and 7.

In one embodiment, the nucleic acid molecule used in the process distinguishes over the sequence shown in table I, application no. 12, columns 5 and 7 by one or more nucleotides or does not consist of the sequence shown in table I, application no. 12, columns 5 and 7. In one embodiment, the nucleic acid molecule of the present invention is less than 100%, 99.999%, 99.99%, 99.9% or 99% identical to the sequence shown in table I, application no. 12, columns 5 and 7. In another embodiment, the nucleic acid molecule does not encode a polypeptide of the sequence shown in table II, application no. 12, columns 5 and 7.

for the disclosure of the paragraphs [0118.0.0.11] to [0120.0.0.11] see paragraphs [0118.0.0.0] to [0120.0.0.0] above.

The expression of nucleic acid molecules with the sequence shown in table I, application no. 12, columns 5 and 7, or nucleic acid molecules which are derived from the amino acid sequences shown in table II, application no. 12, columns 5 and 7 or from polypeptides comprising the consensus sequence shown in table IV, application no. 12, column 7, or their derivatives or homologues encoding polypeptides with the enzymatic or biological activity of a protein as shown in table II, application no. 12, column 3, and conferring an increase of the respective fine chemical (column 6 of application no. 12 in any one of Tables I to IV) after increasing its plastidic expression and/or specific activity in the plastids is advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 12, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 12, column 3 and which confer an increase in the level of the respective fine chemical indicated in table II, application no. 12, column 6 by being expressed either in the cytsol or in an organelle such as a plastid or mitochondria or both, preferably in plastids, and the gene product being localized in the plastid and other parts of the cell or in the plastid as described above.

for the disclosure of the paragraphs [0126.0.0.11] to [0133.0.0.11] see paragraphs [0126.0.0.0] to [0133.0.0.0] above.

Production strains which are also advantageously selected in the process according to the invention are microorganisms selected from the group of green algae, like *Spongioccoccum exentricum, Chlorella sorokiniana* (pyrenoidosa, Jul. 11, 2005), or algae of the genus *Haematococcus, Phaedactylum tricornatum, Volvox* or *Dunaliella* or form the group of fungi like fungi belonging to the *Daccrymycetaceae* family, or non-photosynthetic bacteria, like methylotrophs, flavobacteria, actinomycetes, like streptomyces chrestomyceticus, Mycobacteria like *Mycobacterim phlei, Rhodobacter capsulatus*, or *Brevibacterium linens, Dunaliella* spp., *Phaffia rhodozyma, Phycomyces* sp., *Rhodotorula* spp. Thus, the invention also contemplates embodiments in which a host lacks lutein or lutein precursors, such as the vinca. In a plant of the latter type, the inserted DNA includes genes that code for proteins producing lutein precursors (compounds that can be converted biologically into a compound.with lutein activity) and one or more modifiying enzymes which were originally absent in such a plant.

The invention also contemplates embodiments in which the lutein or lutein precursor compounds in the production of the respective fine chemical, are present in a photosynthetic active organisms chosen as the host; for example, cyanobacteria, moses, algae or plants which, even as a wild type, are capable of producing carotenoids.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 12, columns 5 and 7 or the functional homologues thereof as described herein, preferably conferring above-mentioned activity, i.e. conferring an increase of the respective fine chemical after increasing its plastidic activity, e.g. after increasing the activity of a protein as shown in table II, application no. 12, column 3 by—for example— expression either in the cytsol or in an organelle such as a plastid or mitochondria or both, preferably in plastids and the gene product, e.g. the polypeptide, being localized in the plastid and other parts of the cell or in the plastid as described above.

for the disclosure of the paragraphs [0135.0.0.11] to [0140.0.0.11] see paragraphs [0135.0.0.0] to [0140.0.0.0] above.

Synthetic oligonucleotide primers for the amplification, e.g. as shown in table III, application no. 12, column 7, by means of polymerase chain reaction can be generated on the basis of a sequence shown herein, for example the sequence shown in table I, application no. 12, columns 5 and 7 or the sequences derived from table II, application no. 12, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 12, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 12, column 3 or further functional homologs of the polypeptide of the invention from other organisms.

for the disclosure of the paragraphs [0144.0.0.11] to [0151.0.0.11] see paragraphs [0144.0.0.0] to [0151.0.0.0] above.

Polypeptides having above-mentioned activity, i.e. conferring the increase of the respective fine chemical indicated in table I, application no. 12, column 6, and being derived from other organisms, can be encoded by other DNA sequences which hybridize to the sequences shown in table I, application no. 12, columns 5 and 7, preferably of table IB, application no. 12, columns 5 and 7 under relaxed hybridization conditions and which code on expression for peptides having the respective fine chemical, i.e. lutein increasing activity, when expressed in a way that the gene product, e.g. the polypeptide, being localized in the plastid and other parts of the cell or in the plastid as described above.

for the disclosure of the paragraphs [0153.0.0.11] to [0159.0.0.11] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 12, columns 5 and 7, preferably shown in table IB, application no. 12, columns 5 and 7 is one which is sufficiently complementary to one of the nucleotide sequences shown in table I, application no. 12, columns 5 and 7, preferably shown in table IB, application no. 12, columns 5 and 7 such that it can hybridize to one of the nucleotide sequences shown in table I, application no. 12, columns 5 and 7, preferably shown in table IB, application no. 12, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 12, columns 5 and 7, preferably shown in table IB, application no. 12, columns 5 and 7, or a portion thereof and preferably has above mentioned activity, in particular having a respective fine chemical increasing activity after increasing the activity or an activity of a gene product as shown in table II, application no. 12, column 3 by for example expression either in the cytsol or in an organelle such as a plastid or mitochondria or both, preferably in plastids, and the gene product, e.g. the polypeptide; being localized in the plastid and other parts of the cell or in the plastid as described above.

The nucleic acid molecule of the invention comprises a nucleotide sequence which hybridizes, preferably hybridizes under stringent conditions as defined herein, to one of the nucleotide sequences shown in table I, application no. 12, columns 5 and 7, preferably shown in table IB, application no. 12, columns 5 and 7, or a portion thereof and encodes a protein having above-mentioned activity, e.g. conferring of a lutein or triglycerides, lipids, oils and/or fats containing lutein increase by for example expression either in the cytsol or in an organelle such as a plastid or mitochondria or both, preferably in plastids, and optionally, the activity of a protein as shown in table II, application no. 12, column 3, and the gene product, e.g. the polypeptide, being localized in the plastid and other parts of the cell or in the plastid as described above.

Moreover, the nucleic acid molecule of the invention can comprise only a portion of the coding region of one of the sequences shown in table I, application no. 12, columns 5 and 7, preferably shown in table IB, application no. 12, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the respective fine chemical indicated in Table I, application no. 12, column 6, if its activity is increased by for example expression either in the cytsol or in an organelle such as a plastid or mitochondria or both, preferably in plastids, and the gene product, e.g. the polypeptide, being localized in the plastid and other parts of the cell or in the plastid as described above. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 12, columns 5 and 7, an anti-sense sequence of one of the sequences, e.g., set forth in table I, application no. 12, columns 5 and 7, preferably shown in table IB, application no. 12, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 12, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 12, columns 5 and 7 such that the protein or portion thereof maintains the ability to participate in the fine chemical production, in particular an activity increasing the level of lutein increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 12, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 12, columns 5 and 7 and having above-mentioned activity, e.g. conferring preferably the increase of the respective fine chemical by for example expression either in the cytsol or in an organelle such as a plastid or mitochondria or both, preferably in plastids, and the gene product, e.g. the polypeptide, being localized in the plastid and other parts of the cell or in the plastid as described above.

for the disclosure of the paragraphs [0168.0.0.11] and [0169.0.0.11] see paragraphs [0168.0.0.0] and [0169.0.0.0] above.

The invention further relates to nucleic acid molecules that differ from one of the nucleotide sequences shown in table I, application no. 12, columns 5 and 7 (and portions thereof) due to degeneracy of the genetic code and thus encode a polypeptide of the present invention, in particular a polypeptide having above mentioned activity, e.g. conferring an increase in the respective fine chemical in a organism, e.g. as that polypeptides depicted by the sequence shown in table II, application no. 12, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 12, columns 5 and 7 or the functional homologues. In a still further embodiment, the nucleic acid molecule of the invention encodes a full length protein which is substantially homologous to an amino acid sequence shown in table II, application no. 12, columns 5 and 7 or the functional homologues. However, in a preferred embodiment, the nucleic acid molecule of the present invention does not consist of the sequence shown in table I, application no. 12, columns 5 and 7, preferably as indicated in table IA, application no. 12, columns 5 and 7. Preferably the nucleic acid molecule of the invention is a functional homologue or identical to a nucleic acid molecule indicated in table IB, application no. 12, columns 5 and 7.

for the disclosure of the paragraphs [0171.0.0.11] to [0173.0.0.11] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 12, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 12, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 12, columns 5 and 7.

for the disclosure of the paragraphs [0179.0.0.11] and [0180.0.0.11] see paragraphs [0179.0.0.0] and [0180.0.0.0] above.

Accordingly, the invention relates to nucleic acid molecules encoding a polypeptide having above-mentioned activity, e.g. conferring an increase in the the respective fine chemical in an organisms or parts thereof by for example expression either in the cytsol or in an organelle such as a plastid or mitochondria or both, preferably in plastids (as described), that contain changes in amino acid residues that are not essential for said activity. Such polypeptides differ in amino acid sequence from a sequence contained in the sequences shown in table II, application no. 12, columns 5 and 7, preferably shown in table IIA, application no. 12, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 12, columns 5 and 7, preferably shown in table IIA, application no. 12, columns 5 and 7 and is capable of participation in the increase of production of the fine chemical after increasing its activity, e.g. its expression by for example expression either in the cytsol or in an organelle such as a plastid or mitochondria or both, preferably in plastids and the gene product, e.g. the polypeptide, being localized in the plastid and other parts of the cell or in the plastid as described above. Preferably, the protein encoded by the nucleic acid molecule is at least about 60% identical to the sequence shown in table II, application no. 12, columns 5 and 7, preferably shown in table IIA, application no. 12, columns 5 and 7, more preferably at least about 70% identical to one of the sequences shown in table II, application no. 12, columns 5 and 7, preferably shown in table IIA, application no. 12, columns 5 and 7, even more preferably at least about 80%, 90%, 95% homologous to the sequence shown in table II, application no. 12, columns 5 and 7, preferably shown in table IIA, application no. 12, columns 5 and 7, and most preferably at least about 96%, 97%, 98%, or 99% identical to the sequence shown in table II, application no. 12, columns 5 and 7, preferably shown in table IIA, application no. 12, columns 5 and 7.

for the disclosure of the paragraphs [0182.0.0.11] to [0188.0.0.11] see paragraphs [0182.0.0.0] to [0188.0.0.0] above.

Functional equivalents derived from one of the polypeptides as shown in table II, application no. 12, columns 5 and 7, preferably shown in table IIB, application no. 12, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 12, columns 5 and 7, preferably shown in table IIB, application no. 12, columns 5 and 7 resp., according to the invention and are distinguished by essentially the same properties as the polypeptide as shown in table II, application no. 12, columns 5 and 7, preferably shown in table IIB, application no. 12, columns 5 and 7.

Functional equivalents derived from the nucleic acid sequence as shown in table I, application no. 12, columns 5 and 7, preferably shown in table IB, application no. 12, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 12, columns 5 and 7, preferably shown in table IIB, application no. 12, columns 5 and 7 resp., according to the invention and encode polypeptides having essentially the same properties as the polypeptide as shown in table II, application no. 12, columns 5 and 7, preferably shown in table IIB, application no. 12, columns 5 and 7.

for the disclosure of this paragraph see paragraph [0191.0.0.0] above.

A nucleic acid molecule encoding an homologous to a protein sequence of table II, application no. 12, columns 5 and 7, preferably shown in table IIB, application no. 12, columns 5 and 7 resp., can be created by introducing one or more nucleotide substitutions, additions or deletions into a nucleotide sequence of the nucleic acid molecule of the present invention, in particular of table I, application no. 12, columns 5 and 7, preferably shown in table IB, application no. 12, columns 5 and 7 resp., such that one or more amino acid substitutions, additions or deletions are introduced into the encoded protein. Mutations can be introduced into the encoding sequences of table I, application no. 12, columns 5 and 7, preferably shown in table IB, application no. 12, columns 5 and 7 resp., by standard techniques, such as site-directed mutagenesis and PCR-mediated mutagenesis.

for the disclosure of the paragraphs [0193.0.0.11] to [0196.0.0.11] see paragraphs [0193.0.0.0] to [0196.0.0.0] above.

Homologues of the nucleic acid sequences used, with the sequence shown in table I, application no. 12, columns 5 and 7, preferably shown in table IB, application no. 12, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 12, columns 5 and 7, preferably shown in table IB, application no. 12, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 12, columns 5 and 7, preferably shown in table IB, application no. 12, columns 5 and 7. It is preferred that the nucleic acid molecule comprises as little as possible other nucleotides not shown in any one of table I, application no. 12, columns 5 and 7, preferably shown in table IB, application no. 12, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 12, columns 5 and 7, preferably shown in table IB, application no. 12, columns 5 and 7.

Also preferred is that the nucleic acid molecule used in the process of the invention encodes a polypeptide comprising the sequence shown in table II, application no. 12, columns 5 and 7, preferably shown in table IIB, application no. 12, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 12, columns 5 and 7, preferably shown in table IIB, application no. 12, columns 5 and 7.

In one embodiment, the nucleic acid molecule of the invention or used in the process encodes a polypeptide comprising the sequence shown in table II, application no. 12, columns 5 and 7, preferably shown in table IIB, application no. 12, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 12, columns 5 and 7, preferably shown in table IB, application no. 12, columns 5 and 7.

Polypeptides (=proteins), which still have the essential biological or enzymatic activity of the polypeptide of the present invention conferring an increase of the respective fine chemical indicated in column 6 of Table I, application no. 12, i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 12, columns 5 and 7 expressed under identical conditions.

Homologues of table I, application no. 12, columns 5 and 7 or of the derived sequences of table II, application no. 12, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.11] to [0215.0.0.11] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 12, columns 5 and 7, preferably in table IIB, application no. 12, columns 5 and 7; or a fragment thereof conferring an increase in the amount of the fine chemical according to table IIB, application no. 12, column 6 in an organism or a part thereof b) nucleic acid molecule comprising, preferably at least the mature form, of the nucleic acid molecule shown in table I, application no. 12, columns 5 and 7, preferably in table IB, application no. 12, columns 5 and 7 or a fragment thereof conferring an increase in the amount of the fine chemical according to table IIB, application no. 12, column 6 in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical according to table IIB, application no. 12, column 6 in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical according to table IIB, application no. 12, column 6 in an organism or a part thereof;

e) nucleic acid molecule which hybridizes with a nucleic acid molecule of (a) to (c) under stringent hybridisation conditions and conferring an increase in the amount of the fine chemical according to table IIB, application no. 12, column 6 in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical according to table IIB, application no. 12, column 6 in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical according to table IIB, application no. 12, column 6 in an organism or a part thereof;

h) nucleic acid molecule comprising a nucleic acid molecule which is obtained by amplifying a cDNA library or a genomic library using the primers in table III, application no. 12, column 7 and conferring an increase in the amount of the fine chemical according to table IIB, application no. 12, column 6 in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 12, column 7 and conferring an increase in the amount of the fine chemical in an organism or a part thereof;

k) nucleic acid molecule encoding the amino acid sequence of a polypeptide encoding a domaine of the polypeptide shown in table II, application no. 12, columns 5 and 7 and conferring an increase in the amount of the fine chemical according to table IIB, application no. 12, column 6 in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 12, columns 5 and 7 or a nucleic acid molecule encoding, preferably at least the mature form of, the polypeptide shown in table II, application no. 12, columns 5 and 7, and conferring an increase in the amount of the fine chemical according to table IIB, application no. 12, column 6 in an organism or a part thereof; or which encompasses a sequence which is complementary thereto;

whereby, preferably, the nucleic acid molecule according to (a) to (l) distinguishes over the sequence depicted in table IA and/or IB, application no. 12, columns 5 and 7 by one or more nucleotides. In one embodiment, the nucleic acid molecule of the invention does not consist of the sequence shown in table IA and/or IB, application no. 12, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 12, columns 5 and 7. In a further embodiment the nucleic acid molecule does not encode the polypeptide sequence shown in table IIA and/or IIB, application no. 12, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 12, columns 5 and 7 does not encode a protein of the sequence shown in table IIA and/or IIB, application no. 12, columns 5 and 7. Accordingly, in one embodiment, the protein encoded by a sequence of a nucleic acid according to (a) to (l) does not consist of the sequence shown in table IA and/or IB, application no. 12, columns 5 and 7. In a further embodiment, the protein of the present invention is at least 30% identical to protein sequence depicted in table IIA and/or IIB, application no. 12, columns 5 and 7 and less than 100%, preferably less than 99.999%, 99.99% or 99.9%, more preferably less than 99%, 985, 97%, 96% or 95% identical to the sequence shown in table IIA and/or IIB, application no. 12, columns 5 and 7.

for the disclosure of the paragraphs [0217.0.0.11] to [0226.0.0.11] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 12, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.11] to [0239.0.0.11] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 12, columns 5 and 7 or its derivatives, it is advantageous additionally to express and/or mutate further genes in the organisms. It can be especially advantageously, if additionally at least one further gene of the lutein biosynthetic pathway, e.g. of the DOXP pathway of isoprenoids biosynthesis, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the sequences shown in Table I, application no. 12, columns 5 and 7 with genes which generally support or enhances the growth or yield of the target organism, for example genes which lead to faster growth rate of microorganisms or genes which produces stress-, pathogen, or herbicide resistant plants.

In addition, it might be also advantageously to combine one or more of the sequences indicated in Table I, columns 5 or 7, application no. 12, with genes which modify plant architecture or flower development, in the way, that the plant either produces more flowers, or produces flowers with more petals in order to increase the respective fine chemical production capacity.

In a further embodiment of the process of the invention, therefore, organisms are grown, in which there is simultaneous direct or indirect overexpression of at least one nucleic acid or one of the genes which code for proteins involved in the carotenoids metabolism, in particular in synthesis of zeaxanthin, e.g. as described in Burrr B J. Carotenoids and gen expression. Nutrition 2000, 31; 16(7-8):577-8; DelagadoVargas F, Natural pigments: carotenoids, anthocyanins, and betalains—characteristics, biosynthesis, processing, and stability. Crit Rev Food Sci Nutr 2000; 40(3):173-289. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the above-mentioned biosynthesis genes are the sequences encoding further genes of the carotenoids biosynthetic pathway, such as ε-Lycopene cyclase, β-lycopene cyclase, beta-carotene hydroxylase, and/or ε-carotene hydroxylase. These genes may lead to an increased synthesis of the essential carotenoids, in particular lutein.

In a further advantageous embodiment of the process of the invention, the organisms used in the process are those in which simultaneously a lutein degrading protein is attenuated, in particular by reducing the rate of expression of the corresponding gene.

The respective fine chemical produced can be isolated from the organism by methods with which the skilled worker is familiar. For example, via extraction, salt precipitation, and/or different chromatography methods. The process according to the invention can be conducted batchwise, semibatchwise or continuously. The respective fine chemical produced by this process can be obtained by harvesting the organisms, either from the crop in which they grow, or from the field. This can be done via pressing or extraction of the plant parts.

for the disclosure of the paragraphs [0243.0.0.11] to [0264.0.0.11] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 12, columns 5 and 7 and described herein to achieve an expression in one of said compartments or extracellular.

for the disclosure of the paragraphs [0266.0.0.11] to [0287.0.0.11] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 12, columns 5 and 7 or their homologs is functionally linked to a plastidial targeting sequence. A further preferred embodiment of the invention relates to a vector in which a nucleic acid sequence encoding one of the polypeptides shown in table II, application no. 12, columns 5 and 7 or their homologs is functionally linked to a regulatory sequences which permit the expression in plastids.

for the disclosure of the paragraphs [0289.0.0.11] to [0296.0.0.11] see paragraphs [0289.0.0.0] to [0296.0.0.0] above.

Moreover, a native polypeptide conferring the increase of the respective fine chemical in an organism or part thereof can be isolated from cells (e.g., endothelial cells), for example using the antibody of the present invention as described herein, in particular, an antibody against polypeptides as shown in table II, application no. 12, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 12, columns 5 and 7 or as coded by the nucleic acid molecule shown in table I, application no. 12, columns 5 and 7 or functional homologues thereof.

In one advantageous embodiment, in the method of the present invention the activity of a polypeptide is increased comprising or consisting of the consensus sequence shown in table IV, application no. 12, columns 7 and in one another embodiment, the present invention relates to a polypeptide comprising or consisting of the consensus sequence shown in table IV, application no. 12, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.11] to [0304.0.0.11] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 12, columns 5 and 7 by one or more amino acids. In one embodiment, polypeptide distinguishes form the sequence shown in table IIA and/or IIB, application no. 12, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 12, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 12, columns 5 and 7.

for the disclosure of this paragraph see paragraph [0306.0.0.0] above.

In one embodiment, the invention relates to polypeptide conferring an increase of level of the respective fine chemical indicated in Table IIA and/or IIB, application no. 12, column 6 in an organism or part being encoded by the nucleic acid molecule of the invention or used in the process of the invention and having a sequence which distinguishes from the sequence as shown in table IIA and/or IIB, application no. 12, columns 5 and 7 by one or more amino acids. In another embodiment, said polypeptide of the invention does not consist of the sequence shown in table IIA and/or IIB, application no. 12, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 12, columns 5 and 7.

In one embodiment, the present invention relates to a polypeptide having the activity of the protein as shown in table IIA and/or IIB, application no. 12, column 3, which distinguishes over the sequence depicted in table IIA and/or IIB, application no. 12, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle, for example into the plastid or mitochondria.

for the disclosure of the paragraphs [0309.0.0.11] to [0311.0.0.11] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 12, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 12, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 12, columns 5 and 7 or which is homologous thereto, as defined above.

Accordingly the polypeptide of the present invention can vary from the sequences shown in table IIA and/or IIB, application no. 12, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 12, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 12, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 12, column 3. Differences shall mean at least one amino acid different from the sequences as shown in table II, application no. 12, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 12, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 12, column 3. The nucleic acid molecules and polypeptide molecules of the invention are expressed such that the yield, production, and/or efficiency of production of a desired compound is improved.

Preferably, the compound is a composition comprising the essentially pure fine chemical, i.e. lutein or a recovered or isolated lutein in free or in protein- or membrane-bound form.

for the disclosure of the paragraphs [0320.0.0.11] to [0322.0.0.11] see paragraphs [0320.0.0.0] to [0322.0.0.0] above.

In one embodiment, a protein (=polypeptide) as shown in table II, application no. 12, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 12, column 3, e.g., a protein which does not confer the activity described herein and which is derived from the same or a different organism.

for the disclosure of the paragraphs [0324.0.0.11] to [0329.0.0.11] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 12, columns 5 and 7.

for the disclosure of the paragraphs [0331.0.0.11] to [0346.0.0.11] see paragraphs [0331.0.0.0] to [0346.0.0.0] above.

Accordingly the present invention relates to any cell transgenic for any nucleic acid characterized as part of the invention, e.g. conferring the increase of the respective fine chemical indicated in column 6 of application no. 12 in any one of Talbes I to IV in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 12, column 3. Due to the above mentioned activity the respective fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 12, column 3 or a protein as shown in table II, application no. 12, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 12, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.11] to [0358.0.0.11] see paragraphs [0350.0.0.0] to [0358.0.0.0] above.

Transgenic plants comprising the respective fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The respective fine chemical indicated in column 6 of any one of Tables I to IV, application no. 12 and being produced in the process according to the invention may, however, also be isolated from the plant as one of the above mentioned derivates of lutein or lutein itself and can be isolated by harvesting the plants either from the culture in which they grow or from the field. This can be done for example via expressing, grinding and/or extraction of the plant parts, preferably the plant seeds, plant fruits, plant tubers and the like.

for the disclosure of the paragraphs [0360.0.0.11] to [0362.0.0.11] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the respective fine chemical produced in the process can be isolated. The resulting composition or fraction comprising the respective fine chemical can, if appropriate, subsequently be further purified, if desired mixed with other active ingredients such as fatty acids, vitamins, amino acids, carbohydrates, antibiotics, covitamins, antioxidants, carotenoids, and the like, and, if appropriate, formulated.

In one embodiment, the composition is the fine chemical.

The fine chemical indicated in column 6 of application no. 12 in Table I, and being obtained in the process of the invention are suitable as starting material for the synthesis of further products of value. For example, they can be used in combination with each other or alone for the production of pharmaceuticals, foodstuffs, animal feeds or cosmetics. Accordingly, the present invention relates a method for the production of pharmaceuticals, food stuff, animal feeds, nutrients or cosmetics comprising the steps of the process according to the invention, including the isolation of a composition comprising the fine chemical, e.g. luteinor the isolated respective fine chemical produced, if desired, and formulating the product with a pharmaceutical acceptable carrier or formulating the product in a form acceptable for an application in agriculture. A further embodiment according to the invention is the use of the respective fine chemical indicated in application no. 12, Table I, column 6, and being produced in the process or the use of the transgenic organisms in animal feeds, foodstuffs, medicines, food supplements, cosmetics or pharmaceuticals.

for the disclosure of the paragraphs [0366.0.0.11] to [0369.0.0.11] see paragraphs [0366.0.0.0] to [0369.0.0.0] above.

The fermentation broths obtained in this way, containing in particular the respective fine chemical indicated in column 6 of any one of Tables I to IV; application no. 12 or containig mixtures with other compounds, in particular with other vitamins or e.g. with carotenoids, e.g. with astaxanthin, or fatty acids or containing microorganisms or parts of microorganisms, like plastids, normally have a dry matter content of from 7.5 to 25% by weight. The fermentation broth can be processed further. Depending on requirements, the biomass can be separated, such as, for example, by centrifugation, filtration, decantation, coagulation/flocculation or a combination of these methods, from the fermentation broth or left completely in it. The fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction, freeze-drying, spray drying, spray granulation or by other processes.

As lutein is often localized in membranes or plastids, in one embodiment it is advantageous to avoid a leaching of the cells when the biomass is isolated entirely or partly by separation methods, such as, for example, centrifugation, filtration, decantation, coagulation/flocculation or a combination of these methods, from the fermentation broth. The dry biomass can directly be added to animal feed, provided the lutein concentration is sufficiently high and no toxic compounds are present. In view of the instability of lutein, conditions for drying, e.g. spray or flash-drying, can be mild and can be avoiding oxidation and cis/trans isomerization. For example antioxidants, e.g. BHT, ethoxyquin or other, can be added. In case the lutein concentration in the biomass is to dilute, solvent extraction can be used for their isolation, e.g. with alcohols, ether or other organic solvents, e.g. with methanol, ethanol, aceton, alcoholic potassium hydroxide, glycerol-phenol, liquefied phenol or for example with acids or bases, like trichloroacetatic acid or potassium hydroxide. A wide range of advantageous methods and techniques for the isolation of lutein can be found in the state of the art. Accordingly, it is possible to further purify the produced lutein. For this purpose, the product-containing composition, e.g. a total or partial lipid extraction fraction using organic solvents, e.g. as described above, is subjected for example to a saponification to remove triglycerides, partition between e.g. hexane/methanol (separation of non-polar epiphase from more polar hypophasic derivates) and separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.11] to [0376.0.0.11], [0376.1.0.11] and [0377.0.0.11] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 12, columns 5 and 7, preferably in table IB, application no. 12, columns 5 and 7, and, optionally, isolating the full length cDNA clone or complete genomic clone;
(c) introducing the candidate nucleic acid molecules in host cells, preferably in a plant cell or a microorganism, appropriate for producing the respective fine chemical;
(d) expressing the identified nucleic acid molecules in the host cells;
(e) assaying the respective fine chemical level in the host cells; and
(f) identifying the nucleic acid molecule and its gene product which expression confers an increase in the respective fine chemical as indicated for application no. 12 in any one of Tables I to IV level in the host cell after expression compared to the wild type.

for the disclosure of the paragraphs [0379.0.0.11] to [0383.0.0.11] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 12, column 3, e.g. comparing near identical organisms with low and high activity of the proteins as shown in table II, application no. 12, column 3.

for the disclosure of the paragraphs [0385.0.0.11] to [0404.0.0.11] see paragraphs [0385.0.0.0] to [0404.0.0.0] above.

Accordingly, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical indicated in Column 6, Table I, application no. 12 or for the production of the respective fine chemical and one or more other carotenoids, vitamins or fatty acids. In one embodiment, in the process of the present invention, the produced lutein is used to protect fatty acids against oxidization, e.g. it is in a further step added in a pure form or only partly isolated to a composition comprising fatty acids.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the respective fine chemical in a organism or part thereof, e.g. in a cell.

The nucleic acid molecule of the invention, the vector of the invention or the nucleic acid construct of the invention may also be useful for the production of organisms resistant to inhibitors of the lutein production biosynthesis pathways. In particular, the overexpression of the polypeptide of the present invention may protect an organism such as a microorganism or a plant against inhibitors, which block the lutein, in particular the respective fine chemical synthesis in said organism.

As lutein can protect organisms against damages of oxidative stress, especially singlet oxygens, a increased level of the respective fine chemical can protect plants against herbicides which cause the toxic buildup of oxidative compounds, e.g.

singlet oxygens. For example, inhibition of the protoporphorineogen oxidase (Protox), an enzyme important in the synthesis of chlorophyll and heme biosynthesis results in the loss of chlorophyll and carotenoids and in leaky membranes; the membrane destruction is due to creation of free oxygen radicals (which is also reported for other classic photosynthetic inhibitor herbicides).

Accordingly, in one embodiment, the increase of the level of the respective fine chemical is used to protect plants against herbicides destroying membranes due to the creation of free oxygen radicals.

Examples of inhibitors or herbicides building up oxidative stress are aryl triazion, e.g. sulfentrazone, carfentrazone; or diphenylethers, e.g. acifluorfen, lactofen, or oxyfluorfen; or N-Phenylphthalimide, e.g. flumiclorac or flumioxazin; substituted ureas, e.g. fluometuron, tebuthiuron, diuron, or linuron; triazines, e.g. atrazine, prometryn, ametryn, metributzin, prometon, simazine, or hexazinone: or uracils, e.g. bromacil or terbacil.

In a further embodiment the present invention relates to the use of the antagonist of the present invention, the plant of the present invention or a part thereof, the microorganism or the host cell of the present invention or a part thereof for the production a cosmetic composition or a pharmaceutical composition. Such a composition has an antioxidative activity, photoprotective activity, can be used to protect, treat or heal the above mentioned diseases, e.g. rhypercholesterolemic or cardiovascular diseases, certain cancers, and cataract formation or can be used as an immunostimulatory agent.

The lutein can be also used as stabilizer of other colours or oxygen sensitive compounds, like fatty acids, in particular unsaturated fatty acids.

for the disclosure of the paragraphs [0406.0.0.11] to [0416.0.0.11] see paragraphs [0406.0.0.0] to [0416.0.0.0] above.

An in vivo mutagenesis of organisms such as algae (e.g. *Spongiococcum* sp, e.g. *Spongiococcum exentricum*, *Chlorella* sp., *Haematococcus*, *Phaedactylum tricornatum*, *Volvox* or *Dunaliella*), *Synechocystis* sp. PCC 6803, *Physcometrella patens*, *Saccharomyces*, *Mortierella*, *Escherichia* and others mentioned above, which are beneficial for the production of lutein can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5bromouracil, N-methyl-N-nitro-N-nitrosoguanidine (=NTG), ethyl methanesulfonate (=EMS), hydroxylamine and/or nitrous acid are widely used as chemical agents for random in-vitro mutagensis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired fine chemical.

for the disclosure of the paragraphs [0418.0.0.11] to [0427.0.0.11] see paragraphs [0418.0.0.0] to [0427.0.0.0] above.

for the disclosure of the paragraphs [0427.1.9.11] see paragraphs [0428.1.9.9] above for the disclosure of the paragraphs [0427.2.9.11] see paragraph [0428.2.9.9] above for the disclosure of the paragraphs [0427.3.9.11] see paragraph [0428.3.9.9] above.

Lutein may be produced in *Synechocystis* spec. PCC 6803 The cells of each of independent *Synechocystis* spec. PCC 6803 strains cultured on the BG-11 km agar medium, and untransformed wild-type cells (on BG11 agar medium without kanamycin) can be used to inoculate liquid cultures. For this, cells of a mutant or of the wild-type *Synechocystis* spec. PCC 6803 are transferred from plate into 10 ml of liquid culture in each case. These cultures are cultivated at 28° C. and 30 µmol photons*$(m^2*s)^{-1}$ (30 µE) for about 3 days. After determination of the $OD_{730}$ of the individual cultures, the $OD_{730}$ of all cultures is synchronized by appropriate dilutions with BG-11 (wild types) or e.g. BG-11 km (mutants). These cell density-synchronized cultures are used to inoculate three cultures of the mutant and of the wild-type control. It is thus possible to carry out biochemical analyses using in each case three independently grown cultures of a mutant and of the corresponding wild types. The cultures are grown until the optical density was $OD_{730}$=0.3.

The cell culture medium is removed by centrifugation in an Eppendorf bench centrifuge at 14000 rpm twice. The subsequent disruption of the cells and extraction lutein take place by incubation in an Eppendorf shaker at 30° C., 1000 rpm in 100% methanol for 15 minutes twice, combining the supernatants obtained in each case.

In order to avoid oxidation, the resulting extracts can be analyzed immediate after the extraction with the aid of a Waters Alliance 2690 HPLC system. Lutein can be separated on a reverse phase column and identified by means of a standard. The fluorescence of the substances which can be detected with the aid of a Jasco FP 920 fluorescence detector, can serve as detection system.

for the disclosure of the paragraphs [0428.0.0.11] to [0435.0.0.11] see paragraphs [0428.0.0.0] to [0435.0.0.0] above.

Lutein Production

Lutein can be detected advantageously as described in Deli, J. & Molnar, P., Paprika carotenoids: Analysis, isolation, structure elucidation. Curr. Org. Chem. 6, 1197-1219 (2004) or Fraser, P. D., Pinto, M. E., Holloway, D. E. & Bramley, P. M. Technical advance: application of high-performance liquid chromatography with photodiode array detection to the metabolic profiling of plant isoprenoids. Plant J. 24, 551-558 (2000).

for the disclosure of the paragraphs [0437.0.0.11] and [0438.0.0.11] see paragraphs [0437.0.0.0] and [0438.0.0.0] above.

Example 8

Analysis of the Effect of the Nucleic Acid Molecule on the Production of the Respective Fine Chemical Indicated in Table I, Application No. 12, Column 6

The effect of the genetic modification in plants, fungi, algae or ciliates on the production of a desired compound can be determined by growing the modified microorganisms or the modified plant under suitable conditions (such as those described above) and analyzing the medium and/or the cellular components for the elevated production of desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications).

Lutein can be detected advantageously as described above.

for the disclosure of this paragraph see [0441.0.0.0] above.

Example 9

Purification of the Lutein

Abbreviations: GC-MS, gas liquid chromatography/mass spectrometry; TLC, thin-layer chromatography.

The unambiguous detection for the presence of lutein can be obtained by analyzing recombinant organisms using analytical standard methods: GC, GC-MS or TLC, as described (1997, in: Advances on Lipid Methodology, Fourth Edition; Christie, Oily Press, Dundee, 119-169; 1998, Gaschromatographie-Massenspektrometrie-Verfahren [Gas chromatography/mass spectrometric methods], Lipide 33:343-353).

The total lutein produced in the organism used in the inventive process can be analysed for example according to the following procedure:

The material such as yeasts, E. coli or plants to be analyzed can be disrupted by sonication, grinding in a glass mill, liquid nitrogen and grinding or via other applicable methods. Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, seperation of non-polar epiphase from more polar hypophasic derivatives and chromatography.

Characterization of the Transgenic Plants

In order to confirm that lutein biosynthesis in the transgenic plants is influenced by the expression of the polypeptides described herein, the lutein content in leaves, seeds and/or preferably flowers of the plants transformed with the described constructs (Arabidopsis thaliana, Brassica napus and Nicotiana tabacum) is analyzed. For this purpose, the transgenic plants are grown in a greenhouse, and plants which express the gene coding for polypeptide of the invention or used in the method of the invention are identified at the Northern level. The lutein content in flowers, leaves or seeds of these plants is measured. In all, the lutein concentration is raised by comparison with untransformed plants.

If required and desired, further chromatography steps with a suitable resin may follow. Advantageously, the lutein can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

for the disclosure of the paragraphs [0446.0.0.11] to [0496.0.0.11] see paragraphs [0446.0.0.0] to [0496.0.0.0] above.

As an alternative, the lutein can be detected advantageously as described above.

The results of the different plant analyses can be seen from the table, which follows:

TABLE VI

| ORF | Metabolite | Method/Analytics | Min.-Value | Max.-Value |
|---|---|---|---|---|
| b2344 | Lutein | LC | 1.39 | 2.15 | for the disclosure of the paragraphs [0499.0.0.11] and [0500.0.0.11] see paragraphs [0499.0.0.0] and [0500.0.0.0] above.

Example 15a

Engineering Ryegrass Plants by Over-Expressing b2344 from E. coli or Homologs of b2344 from Other Organisms for the disclosure of the paragraphs [0502.0.0.11] to [0508.0.0.11] see paragraphs [0502.0.0.0] to [0508.0.0.0] above.

Example 15b

Engineering Soybean Plants by Over-Expressing b2344 from *E. coli* or Homologs of b2344 from Other Organisms for the disclosure of the paragraphs [0510.0.0.11] to [0513.0.0.11] see paragraphs [0510.0.0.0] to [0513.0.0.0] above.

Example 15c

Engineering Corn Plants by Over-Expressing b2344 from *E. coli* or Homologs of b2344 from Other Organisms for the disclosure of the paragraphs [0515.0.0.11] to [0540.0.0.11] see paragraphs [0515.0.0.0] to [0540.0.0.0] above.

Example 15d

Engineering Wheat Plants by Over-Expressing b2344 from *E. coli* or Homologs of b2344 from Other Organisms for the disclosure of the paragraphs [0542.0.0.11] to [0544.0.0.11] see paragraphs [0542.0.0.0] to [0544.0.0.0] above.

Example 15e

Engineering Rapeseed/Canola Plants by Over-Expressing b2344 from *E. coli* or Homologs of b2344 from Other Organisms for the disclosure of the paragraphs [0546.0.0.11] to [0549.0.0.11] see paragraphs [0544.0.0.0] to [0549.0.0.0] above.

Example 15f

Engineering Alfalfa Plants by Over-Expressing b2344 from *E. coli* or Homologs of b2344 from Other Organisms for the disclosure of the paragraphs [0551.0.0.11] to [0554.0.0.11] see paragraphs [0551.0.0.0] to [0554.0.0.0] above.

./.
for the disclosure of this paragraph see [0554.2.0.0] above.
for the disclosure of this paragraph see [0555.0.0.0] above.
for the disclosure of this paragraph see [0001.0.0.0].

Sterols are a class of essential, natural compounds required by all eukaryotes to complete their life cycle. In animals, cholesterol is typically the major sterol while in fungi it is ergosterol. Plants produce a class of sterols called phytosterols. Phytosterols are natural components of many vegetables and grains. The term "phytosterols" covers plant sterols and plant stanols. Plant sterols are naturally occurring substances present in the diet as minor components of vegetable oils. The structures of these plant sterols are similar to that of cholesterol with an extra methyl or ethyl group and a double bond in the side chain. Saturated plant sterols, referred to as stanols, have no double bond in the ring structure.

Phytosterols (including plant sterols and stanols) are natural components of plant foods, especially plant oils, seeds and nuts, cereals and legumes specially of edible vegetable oils such as sunflower seed oil and, as such are natural constituents of the human diet. The most common phytosterols are beta-sitosterol, campesterol, and stigmasterol. Beta-sitosterol is found in high amounts in nuts.

A high concentration of cholesterol in serum, i.e., hypercholesterolemia, is a wellknown risk factor for coronary heart disease (CHD). Blood cholesterol levels can be decreased by following diets, which are low in saturated fat, high in polyunsaturated fat and low in cholesterol. Although considerable achievements have been made in terms of knowledge and education, consumers still find it difficult to follow healthy eating advice.

Both plant sterols and plant stanols are effective in lowering plasma total and low density lipoprotein (LDL) cholesterol and this occurs by inhibiting the absorption of cholesterol from the small intestine. The plasma cholesterol-lowering properties of plant sterols have been known since the 1950s (Pollak, Circulation, 7, 702-706.1953). They have been used as cholesterol-lowering agents, first in a free form (Pollak and Kritchevsky, Sitosterol. In: Monographs on Aherosclerosis. Clarkson T B, Kritchevsky D, Pollak O J, eds. New York, Basel, Karger 1981; 1-219) and recently mainly as esterified phytosterols (Katan et al., Mayo Clin Proc 2003; 78: 965-978).

The consumption of plant sterols and plant stanols lowers blood cholesterol levels by inhibiting the absorption of dietary and endogenously-produced cholesterol from the small intestine and the plant sterols/stanols are only very poorly absorbed themselves. This inhibition is related to the similarity in physico-chemical properties of plant sterols and stanols and cholesterol. Plant sterols and plant stanols appear to be without hazard to health, having been shown without adverse effects in a large number of human studies. They show no evidence of toxicity even at high dose levels and gastro-intestinal absorption is low.

The most abundant sterols of vascular plants are campesterol, sitosterol and stigmasterol, all of which contain a double bond between the carbon atoms at positions 5 and 6 and are classified as delta-5 sterols. Exemplary naturally occurring delta-5 plant sterols are isofucosterol, sitosterol, stigmasterol, campesterol, cholesterol, and dihydrobrassicasterol. Exemplary naturally occurring non-delta-5 plant sterols are cycloartenol, 24-methylene cycloartenol, cycloeucalenol, and obtusifoliol.

The ratio of delta-5 to non-delta-5 sterols in plants can be an important factor relating to insect pest resistance. Insect pests are unable to synthesize de novo the steroid nucleus and depend upon external sources of sterols in their food source for production of necessary steroid compounds. In particular, insect pests require an external source of delta-5 sterols. By way of example, externally provided delta-5 sterols are necessary for the production of ecdysteroids, hormones that control reproduction and development. See, e.g., Costet et al., Proc. Natl. Acad. Sci. USA, 84:643 (1987) and Corio-Costet et al., Archives of Insect Biochem. Physiol., 11:47 (1989).

US 20020148006 and WO 98/45457 describes the modulation of phytosterol compositions to confer resistance to insects, nematodes, fungi and/or environmental stresses, and/or to improve the nutritional value of plants by using a DNA sequence encoding a first enzyme; which binds a first sterol and is preferably selected from the group consisting of S-adenosyl-L-methionine-$L_{24(25)}$-sterol methyl transferase, a C-4 demethylase, a cycloeucalenol to obtusifoliol-isomerase, a 14-α-demethylase, a $\Delta_8$ to $\Delta_7$-isomerase, a $\Delta_7$-C-5-desaturase and a 24,25-reductase, and produces a second sterol and a 3' non-translated region which causes polyadenylation at the 3' end of the RNA.

WO 93/16187 discloses new plants containing in its genome one or more genes involved in the early stages of phytosterol biosynthesis, preferably the genes encode mevalonate kinase.

U.S. Pat. No. 5,306,862, U.S. Pat. No. 5,589,619, U.S. Pat. No. 5,365,017, U.S. Pat. No. 5,349,126 and US 20030150008 describe a method of increasing sterol (and squalene) accumulation in a plant based on an increased HMG-CoA reductase activity to increase the pest resistance of transgenic plants.

WO 97/48793 discloses a C-14 sterol reductase polypeptide for the genetic manipulation of a plant sterol biosynthetic pathway.

US 20040172680 disclose the use of a gene expressing a SMT1 (sterol methyltransferase) to increase the level of sterols in the seeds of plants. A DNA sequence encoding sterol methyltransferase isolated from *Zea mays* is disclosed in WO 00/08190. Bouvier-Nav et al in Eur. J. Biochem. 256, 88-96 (1988) describes two families of sterol methyl transferases (SMTs), The first (SMT1) applying to cycloartenol and the second (SMT2) to 24-methylene lophenol. Schaller et al (Plant Physiology (1998) 118: 461-169) describes the overexpression of SMT2 from *Arabidopsis* in tobacco resulting in a change in the ratio of 24-methyl cholesterol to sitosterol in the tobacco leaf.

U.S. Pat. No. 6,723,837 and US 20040199940 disclose nucleic acid molecules encoding proteins and fragments of proteins associated with sterol and phytosterol metabolism as well as cells, that have been manipulated to contain increased levels or overexpress at least one sterol or phytosterol compound. The protein or fragment is selected from the group consisting of a HES1, HMGCoA reductase, squalene synthase, cycloartenol synthase, SMTI, SMTII and UPC, preferably from member of the KES1/HES1/OSH1 family of oxysterol-binding (OSBP) proteins comprising an oxysterol-binding protein consensus sequence—E(K, Q) xSH (H, R) PPx (S, T, A, C, F)A. One class of proteins, oxysterol-binding proteins, have been reported in humans and yeast (Jiang et al., Yeast 10: 341-353 (1994), the entirety of which is herein incorporated by reference). These proteins have been reported to modulate ergosterol levels in yeast (Jiang et al., Yeast 10: 341-353 (1994)). In particular, Jiang et al., reported three genes KES1, HES1 and OSH1, which encode proteins containing an oxysterol-binding region.

Transgenic plants having altered sterol profiles could be instrumental in establishing a dietary approach to cholesterol management and cardiovascular disease prevention. The altered phytosterol profile further leads to pest resistance.

Although people consume plant sterols every day in their normal diet, the amount is not great enough to have a significant blood cholesterol lowering effect. The intake of phytosterols varies among different populations according to the food products being consumed, but the average daily Western diet is reported to contain 150-300 mg of these sterols (de Vries et al., J Food Comp Anal 1997; 19: 115-141; Björkhem et al. Inborn errors in bile acid biosynthesis and storage of sterols other than cholesterol. In: The Metabolic and Molecular Bases of Inherited Disease. Scriver C S, Beaudet A L, Sly W S, Valle D, eds. New York, McGraw-Hill 2001; 2961-2988). In order to achieve a cholesterol-lowering benefit, approximately 1 g/day of plant sterols need to be consumed (Hendriks et al., European Journal of Clinical Nutrition, 53, 319-327.1999).

Phytosterols are found naturally in plant foods at low levels. The enrichment of foods such as margarines with plant sterols and stanols is one of the recent developments in functional foods to enhance the cholesterol-lowering ability of traditional food products. Incorporation of additional phytosterols into the diet may be an effective way of lowering total and LDL cholesterol levels. The non-esterified phytosterols can be used as novel food ingredients in:
(a) bakery products and cereals (eg, breakfast cereals, breakfast bars);
(b) dairy products such as low and reduced fat liquid milk, low and reduced fat yoghurt and yoghurt products, and dairy based desserts;
(c) non-carbonated soft drinks like low and reduced fat soy beverages and low and reduced fat soy-based yoghurts;
(d) meat products or edible fats and oils (eg, mayonnaise, spice sauces, salad dressings);
(e) margarine; and
table spreads or dietary fats.

When edible oils undergo normal refining, plant sterols are partially extracted. It is estimated that 2500 tonnes of vegetable oil needs to be refined to produce 1 tonne of plant sterols. Plant stanols are obtained by hydrogenation of the plant sterols.

Another source of plant sterols is tall oil, derived from the process of paper production from wood and approximately 2500 tons of pine is required to produce 1 ton of plant sterols. Tall oil also contains a higher proportion of plant stanols (primarily b-sitostanol) than do vegetable oils.

To ensure a high quality of foods and animal feeds, it is therefore necessary to add sterols in a balanced manner to suit the organism.

Accordingly, there is still a great demand for new and more suitable genes which encode proteins or regulators which participate in the biosynthesis of sterols and make it possible to produce sterols specifically on an industrial scale without unwanted byproducts forming. In the selection of genes for or regulators of biosynthesis two characteristics above all are particularly important. On the one hand, there is as ever a need for improved processes for obtaining the highest possible contents of sterols on the other hand as less as possible byproducts should be produced in the production process.

for the disclosure of this paragraph see [0013.0.0.0] above.

Accordingly, in a first embodiment, in context of paragraphs [0001.n.n.12] to [0555.n.n.12] the invention relates to a process for the production of a fine chemical, whereby the fine chemical are sterols. Accordingly, in the present invention, the term "the fine chemical" as used herein relates to "sterols". Further, the term "the fine chemicals" as used herein also relates to fine chemicals comprising sterols.

In one embodiment, the term "the fine chemical" means phytosterols, plant sterols and plant stanols. Throughout the specification the term "the fine chemical" means phytosterols and ester, thioester or sterols in free form or bound to other compounds. For the purpose of this description, the term sterol/stanol refers both to free sterols/stanols and conjugated sterols/stanols, for example, where the 3hydroxy group is esterified by a fatty acid chain or phenolic acid to give a steryl/stanyl ester. As used herein, the term "phytosterol" includes all phytosterols without limitation, for example: sitosterol, campesterol, stigmasterol, brassicasterol, desmosterol, chalinosterol, poriferasterol, clionasterol, the corresponding stanols and all natural or synthesized forms and derivatives thereof, including isomers. It is to be understood that modifications to the phytosterols i.e. to include side chains also falls within the purview of this invention. All those derivates forms are summarized as "conjugates". In an preferred embodiment, the term "the fine chemical" or the term "phytosterol" or the term "the respective fine chemical" means at least one chemical compound plant sterols and plant stanols selected from the group "beta-sitosterol, sitostanol, stigmasterol, brassicasterol, campestanol, isofucosterol and campesterol", preferred "beta-sitosterol, campesterol, and/or stigmasterol", most preferred "beta-sitosterol and/or campesterol". Also preferably, are esters of sterols/stanols with C10-24 fatty acids.

Increased phytosterol content normally means an increased total phytosterol content. However, an increased phytosterol content also means, in particular, a modified content of the above-described compounds ("beta-sitosterol, sitostanol, stigmasterol, brassicasterol, campestanol, isofucosterol and campesterol") with phytosterol activity, without the need for an inevitable increase in the total phytosterol content.

Accordingly, the present invention relates to a process for the production of sterols which comprises
(a) increasing or generating the activity of a protein as shown in table II, application no. 13, column 3 encoded by the nucleic acid sequences as shown in table I, application no. 13, column 5, in an organelle of a microorganism or plant, or
(b) increasing or generating the activity of a protein as shown in table II, application no. 13, column 3 encoded by the nucleic acid sequences as shown in table I, application no. 13, column 5 in the plastid of a microorganism or plant, or in one or more parts thereof; and
(c) growing the organism under conditions which permit the production of the fine chemical, thus sterols or fine chemicals comprising sterols, in said organism or in the culture medium surrounding the organism.

Accordingly, the term "the fine chemical" means in one embodiment "sterols" in relation to all sequences listed in Table I to IV, application no. 13

In another embodiment the present invention is related to a process for the production of sterols, which comprises
(a) increasing or generating the activity of a protein as shown in table II, application no. 13 column 3 encoded by the nucleic acid sequences as shown in table I, application no. 13, column 5, in an organelle of a non-human organism, or
(b) increasing or generating the activity of a protein as shown in table II, application no. 13, column 3 encoded by the nucleic acid sequences as shown in table I, application no. 13, column 5, which are joined to a nucleic acid sequence encoding a transit peptide in a non-human organism, or in one or more parts thereof; or
(c) increasing or generating the activity of a protein as shown in table II, application no. 13, column 3 encoded by the nucleic acid sequences as shown in table I, application no. 13, column 5, which are joined to a nucleic acid sequence encoding chloroplast localization sequence, in a non-human organism, or in one or more parts thereof, and
(d) growing the organism under conditions which permit the production of sterols in said organism.

In another embodiment, the present invention relates to a process for the production of sterols, which comprises
(a) increasing or generating the activity of a protein as shown in table II, application no. 13, column 3 encoded by the nucleic acid sequences as shown in table I, application no. 13, column 5, in an organelle of a microorganism or plant through the transformation of the organelle, or
(b) increasing or generating the activity of a protein as shown in table II, application no. 13, column 3 encoded by the nucleic acid sequences as shown in table I, application no. 13, column 5 in the plastid of a microorganism or plant, or in one or more parts thereof through the transformation of the plastids; and
(c) growing the organism under conditions which permit the production of the fine chemical, thus, sterols or fine chemicals comprising sterols, in said organism or in the culture medium surrounding the organism.

Advantagously the activity of the protein as shown in table II, application no. 13, column 3 encoded by the nucleic acid sequences as shown in table I, application no. 13, column 5 is increased or generated in the abovementioned process in the plastid of a microorganism or plant.

for the disclosure of the paragraphs [0019.0.0.12] to [0024.0.0.12] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 13, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 13, column 3 and its homologs as disclosed in table I, application no. 13, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 13, column 3 and its homologs as disclosed in table I, application no. 13, columns 5 and 7.

for the disclosure of the paragraphs [0027.0.0.12] to [0029.0.0.12] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 13, columns 5 and 7. The person skilled in the art is able to join said sequences in a functional manner. Advantageously the transit peptide part is cleaved off from the protein part shown in table II, application no. 13, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 13, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 13, columns 5 and 7. In case of the amino acid sequence QIA CSS the three amino acids in front of the start methionine are stemming from the LIC (=ligatation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 13, columns 5 and 7. Furthermore the skilled worker is aware of the fact that there is not a need for such short sequences in the expression of the genes.

Table V: Examples of transit peptides disclosed by von Heijne et al.: for the disclosure of the Table V see paragraphs [0030.2.0.0] above.

Alternatively to the targeting of the sequences shown in table II, application no. 13, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 13, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.12] and [0030.3.0.12] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 13, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table 1, application no. 13, columns 5 and 7 or a sequence encoding a protein, as depicted in table II, application no. 13, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table, 1, application no. 13, columns 5 and 7 or a sequence encoding a protein, as depicted in table II, application no. 13, columns 5 and 7 in such a manner that the viroid sequence transports a sequence transcribed from a sequence as depicted in table 1 application no. 13, columns 5 and 7 or a sequence encoding a protein as depicted in table II, application no. 13, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 13, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 13, columns 5 and 7.

In a preferred embodiment of the invention the nucleic acid sequences as shown in table I, application no. 13, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 13, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.12] and [0032.0.0.12] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 13, column 3. Preferably the modification of the activity of a protein as shown in table II, application no. 13, column 3 or their combination can be achieved by joining the protein to a transit peptide.

Surprisingly it was found, that the transgenic expression of the *E. coli* proteins shown in table II, application no. 13, column 3 in plastids of a plant such as *Arabidopsis thaliana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *E. coli* protein b0931 or b1410 in combination with a plastidal targeting sequence in *Arabidopsis thaliana* conferred an increase in beta-sitosterol.

Surprisingly it was found, that the transgenic expression of the *E. coli* protein b1410 or b1556 or b2022 or b3708 in combination with a plastidal targeting sequence in *Arabidopsis thaliana* conferred an increase in campesterol.

Surprisingly it was found, that the transgenic expression of the *E. coli* protein b1704 in combination with a plastidal targeting sequence in *Arabidopsis thaliana* conferred an increase in stigmasterol.

Surprisingly it was found, that the transgenic expression of the *Saccharomyces cerevisiae* protein YDR035W or YLR027C in combination with a plastidal targeting sequence in *Arabidopsis thaliana* conferred an increase in beta-sitosterol.

Surprisingly it was found, that the transgenic expression of the *Saccharomyces cerevisiae* protein YDR035W or YLR027C or YNL241C in combination with a plastidal targeting sequence in *Arabidopsis thaliana* conferred an increase in campesterol.

for the disclosure of this paragraph see paragraph [0035.0.0.0] above.

The sequence of b0931 from *Escherichia coli* (Acession PIR:JQ0756) has been published in Blattner et al., Science 277 (5331), 1453-1474 (1997), and its activity is being defined as "nicotinate phosphoribosyltransferase". Accordingly, in one embodiment, the process of the present invention comprises the use of a "nicotinate phosphoribosyltransferase" or its homolog, e.g. as shown herein, for the production of the fine chemical, meaning of sterols, in particular for increasing the amount of beta-sitosterol in free or bound form in an organism or a part thereof, as mentioned. In one embodiment, in the process of the present invention the activity of a b0931 protein is increased or generated, e.g. from *Escherichia coli* or a homolog thereof, preferably linked at least to one transit peptide as mentioned for example in table V.

In another embodiment, in the process of the present invention the activity of a b0931 protein is increased or generated in a subcellular compartment of the organism or organism cell such as in an organelle like a plastid or mitochondria.

The sequence of b1410 from *Escherichia coli* (Accession NP_415928) has been published in Blattner et al., Science 277 (5331), 1453-1474 (1997), and its activity is being defined as "putative methylase with S-adenosyl-L-methionine-dependent methyltransferase domain and alpha/beta-hydrolase domain". Accordingly, in one embodiment, the process of the present invention comprises the use of a "putative methylase with S-adenosyl-L-methionine-dependent methyltransferase domain and alpha/beta-hydrolase domain" or its homolog, e.g. as shown herein, for the production of the fine chemical, meaning of sterols, in particular for increasing the amount of beta-sitosterol and/or campesterol in free or bound form in an organism or a part thereof, as mentioned. In one embodiment, in the process of the present invention the activity of a b1410 protein is increased or generated, e.g. from *Escherichia coli* or a homolog thereof, preferably linked at least to one transit peptide as mentioned for example in table V.

In another embodiment, in the process of the present invention the activity of a b1410 protein is increased or generated in a subcellular compartment of the organism or organism cell such as in an organelle like a plastid or mitochondria.

The sequence of b1556 from *Escherichia coli* (Accession NP_416074) has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of sterols, in particular for increasing the amount of campesterol in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1704 from *Escherichia coli* (Accession NP_416219) has been published in Blattner et al., Science 277 (5331), 1453-1474 (1997), and its activity is being defined as "3-deoxy-D-arabinoheptulosonate-7-phosphate synthase (DAHP synthetase), tryptophan-repressible". Accordingly, in one embodiment, the process of the present invention comprises the use of a "3-deoxy-D-arabinoheptulosonate-7-phosphate synthase (DAHP synthetase), tryptophan-repressible" or its homolog, e.g. as shown herein, for the production of the fine chemical, meaning of sterols, in particular for increasing the amount of stigmasterol in free or bound form in an organism or a part thereof, as mentioned. In one embodiment, in the process of the present invention the activity of a b1704 protein is increased or generated, e.g. from *Escherichia coli* or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b2022 from *Escherichia coli* (Accession NP_416526) has been published in Blattner et al., Science 277 (5331), 1453-1474 (1997), and its activity is being defined as "bifunctional histidinol-phosphatase/imidazoleglycerol-phosphate dehydratase". Accordingly, in one embodiment, the process of the present invention comprises the use of a "bifunctional histidinol-phosphatase/imidazoleglycerol-phosphate dehydratase" or its homolog, e.g. as shown herein, for the production of the fine chemical, meaning of sterols, in particular for increasing the amount of campesterol in free or bound form in an organism or a part thereof, as mentioned. In one embodiment, in the process of the present invention the activity of a b2022 protein is increased or generated, e.g. from *Escherichia coli* or a homolog thereof, preferably linked at least to one transit peptide as mentioned for example in table V.

In another embodiment, in the process of the present invention the activity of a b2022 protein is increased or generated in a subcellular compartment of the organism or organism cell such as in an organelle like a plastid or mitochondria.

The sequence of b3708 from *Escherichia coli* (Accession PIR:WZEC) has been published in Blattner et al., Science 277 (5331), 1453-1474 (1997), and its activity is being defined as "tryptophan deaminase, PLP-dependent". Accordingly, in one embodiment, the process of the present invention comprises the use of a "tryptophan deaminase, PLP-dependent" or its homolog, e.g. as shown herein, for the production of the fine chemical, meaning of sterols, in particular for increasing the amount of campesterol in free or bound form in an organism or a part thereof, as mentioned. In one embodiment, in the process of the present invention the activity of a b3708 protein is increased or generated, e.g. from *Escherichia coli* or a homolog thereof, preferably linked at least to one transit peptide as mentioned for example in table V.

In another embodiment, in the process of the present invention the activity of a b3708 protein is increased or generated in a subcellular compartment of the organism or organism cell such as in an organelle like a plastid or mitochondria.

The sequence of YDR035W from *Saccharomyces cerevisiae* (NP_010320) has been published in published in Jacq et al., Nature 387 (6632 Suppl), 75-78, 1997 and Goffeau, Science 274 (5287), 546-547, 1996, and its activity is being defined as "3-deoxy-D-arabino-heptulosonate 7-phosphate (DAHP) synthase". Accordingly, in one embodiment, the process of the present invention comprises the use of a "3-deoxy-D-arabino-heptulosonate 7-phosphate (DAHP) synthase" or its homolog, e.g. as shown herein, for the production of the fine chemical, meaning of sterols, in particular for increasing the amount of beta-sitosterol and/or campesterol in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of a YDR035W protein is increased or generated in a subcellular compartment of the organism or organism cell such as in an organelle like a plastid or mitochondria.

The sequence of YLR027C from *Saccharomyces cerevisiae* (Accession NP_013127) has been published in published in Jacq et al., Nature 387 (6632 Suppl), 75-78, 1997 and Goffeau, Science 274 (5287), 546-547, 1996, and its activity is being defined as "aspartate aminotransferase". Accordingly, in one embodiment, the process of the present invention comprises the use of a "aspartate aminotransferase" or its homolog, e.g. as shown herein, for the production of the fine chemical, meaning of sterols, in particular for increasing the amount of campesterol and/or beta-sitosterol in free or bound form in an organism or a part thereof, as mentioned. In one embodiment, in the process of the present invention the activity of a YLR027C protein is increased or generated, e.g. from *Saccharomyces cerevisiae* or a homolog thereof, preferably linked at least to one transit peptide as mentioned for example in table V.

In another embodiment, in the process of the present invention the activity of a YLR027C protein is increased or generated in a subcellular compartment of the organism or organism cell such as in an organelle like a plastid or mitochondria.

The sequence of YNL241C from *Saccharomyces cerevisiae* (Accession NP_014158) has been published in published in Jacq et al., Nature 387 (6632 Suppl), 75-78, 1997 and Goffeau, Science 274 (5287), 546-547, 1996, and its activity is being defined as "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of sterols, in particular for increasing the amount of campesterol in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of a YNL241C protein is increased or generated in a subcellular compartment of the organism or organism cell such as in an organelle like a plastid or mitochondria.

In one embodiment, the homolog of the b0931, b1410, b1556, b1704, 2022 and/or b3708 is a homolog having said activity and being derived from bacteria. In one embodiment, the homolog of the b0931, b1410, b1556, b1704, 2022 and/or b3708 is a homolog having said activity and being derived from Proteobacteria. In one embodiment, the homolog of the b0931, b1410, b1556, b1704, 2022 and/or b3708 is a homolog having said activity and being derived from Gammaproteobacteria. In one embodiment, the homolog of the b0931, b1410, b1556, b1704, 2022 and/or b3708 is a homolog having said activity and being derived from Enterobacteriales. In one embodiment, the homolog of the b0931, b1410, b1556, b1704, 2022 and/or b3708 is a homolog having said activity and being derived from Enterobacteriaceae. In one embodiment, the homolog of the b0931, b1410, b1556, b1704, 2022 and/or b3708 is a homolog having said activity and being derived from *Escherichia*, preferably from *Escherichia coli*.

In one embodiment, the homolog of the YDR035w, YLR027c and/or YNL241c is a homolog having said activity and being derived from an eukaryotic. In one embodiment, the homolog of the YDR035w, YLR027c and/or YNL241c is a homolog having said activity and being derived from Fungi. In one embodiment, the homolog of the YDR035w, YLR027c and/or YNL241c is a homolog having said activity and being derived from Ascomyceta. In one embodiment, the homolog of the YDR035w, YLR027c and/or YNL241c is a homolog having said activity and being derived from *Saccharomycotina*. In one embodiment, the homolog of the YDR035w, YLR027c and/or YNL241c is a homolog having said activity and being derived from *Saccharomycetes*. In one embodiment, the homolog of the YDR035w, YLR027c and/or YNL241c is a homolog having said activity and being derived from *Saccharomycetales*. In one embodiment, the homolog of the YDR035w, YLR027c and/or YNL241c is a homolog having said activity and being derived from Saccharomycetaceae. In one embodiment, the homolog of the YDR035w, YLR027c and/or YNL241c is a homolog having said activity and being derived from *Saccharomycetes*.

Homologs of the polypeptide disclosed in table II, application no. 13, column 3 may be the polypeptides encoded by the nucleic acid molecules indicated in table I, application no. 13, column 7, resp., or may be the polypeptides indicated in table II, application no. 13, column 7, resp.

for the disclosure of this paragraph see paragraph [0038.0.0.0] above.

In accordance with the invention, a protein or polypeptide has the "activity of an protein as shown in table II, application no. 13, column 3" if its de novo activity, or its increased expression directly or indirectly leads to an increased in the level of the fine chemical indicated in the respective line of table II, application no. 13, column 6 "metabolite" in the organism or a part thereof, preferably in a cell of said organism, more preferably in an organelle such as a plastid or mitochondria of said organism. The protein has the above mentioned activities of a protein as shown in table II, application no. 13, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 13, column 3, or which has at least 10% of the original enzymatic or biological activity, preferably 20%, particularly preferably 30%, most particularly preferably 40% in comparison to a protein as shown in the respective line of table II, application no. 13, column 3 of *E. coli* or *Saccharomyces cerevisiae*.

for the disclosure of the paragraphs [0040.0.0.12] to [0047.0.0.12] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 13, column 3 its biochemical or genetical causes and the increased amount of the respective fine chemical.

for the disclosure of the paragraphs [0049.0.0.12] to [0051.0.0.12] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 13, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.12] to [0058.0.0.12] see paragraphs [0053.0.0.0] to [0058.0.0.0] above.

In case the activity of the *Escherichia coli* protein b0931 or its homologs, e.g. a "nicotinate phosphoribosyltransferase" is increased, advantageously in an organelle such as a plastid or mitochondria, preferably, an increase of the fine chemical, preferably of free beta sitosterol between 13% and 27% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased, advantageously in an organelle such as a plastid or mitochondria, preferably, an increase of the fine chemical, preferably of free beta-sitosterol between 20% and 26% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased, advantageously in an organelle such as a plastid or mitochondria, preferably, an increase of the fine chemical, preferably of free beta campesterol between 19% and 23% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased, advantageously in an organelle such as a plastid or mitochondria, preferably, an increase of the fine chemical, preferably of free beta-sitosterol between 20% and 26% or more and beta campesterol between 19% and 23% or more is conferred.

In case the activity of the *Escherichia coli* protein b1556 or its homologs, e.g. a "Qin prophage" is increased, advantageously in an organelle such as a plastid or mitochondria, preferably, an increase of the fine chemical, preferably of free campesterol between 26% and 52% or more is conferred.

In case the activity of the *Escherichia coli* protein b1704 or its homologs, e.g. a "3-deoxy-D-arabinoheptulosonate-7-phosphate synthase (DAHP synthetase), tryptophanrepressible" is increased, advantageously in an organelle such as a plastid or mitochondria, preferably, an increase of the fine chemical, preferably of free stigmasterol between 83% and 665% or more is conferred.

In case the activity of the *Escherichia coli* protein b2022 or its homologs, e.g. a "bifunctional histidinol-phosphatase/imidazoleglycerol-phosphate dehydratase" is increased, advantageously in an organelle such as a plastid or mitochondria, preferably, an increase of the fine chemical, preferably of free campesterol between 22% and 27% or more is conferred.

In case the activity of the *Escherichia coli* protein b3708 or its homologs, e.g. a "tryptophan deaminase, PLP-dependent" is increased, advantageously in an organelle such as a plastid or mitochondria, preferably, an increase of the fine chemical, preferably of free campesterol between 18% and 85% or more is conferred.

In case the activity of the *Saccharomyces cerevisiae* protein YDR035W or its homologs, e.g. a "3-deoxy-D-arabino-heptulosonate 7-phosphate (DAHP) synthase" is increased, advantageously in an organelle such as a plastid or mitochondria, preferably, an increase of the fine chemical, preferably of free beta-sitosterol between 15% and 22% or more is conferred.

In case the activity of the *Saccharomyces cerevisiae* protein YDR035W or its homologs, e.g. a "3-deoxy-D-arabino-heptulosonate 7-phosphate (DAHP) synthase" is increased, advantageously in an organelle such as a plastid or mitochondria, preferably, an increase of the fine chemical, preferably of free campesterol between 20% and 25% or more is conferred.

In case the activity of the *Saccharomyces cerevisiae* protein YDR035W or its homologs, e.g. a "3-deoxy-D-arabino-heptulosonate 7-phosphate (DAHP) synthase" is increased, advantageously in an organelle such as a plastid or mitochondria, preferably, an increase of the fine chemical, preferably of free beta-sitosterol between 15% and 22% or more and free campesterol between 20% and 25% or more is conferred.

In case the activity of the *Saccharomyces cerevisiae* protein YLR027C or its homologs, e.g. a "aspartate aminotransferase" is increased, advantageously in an organelle such as a plastid or mitochondria, preferably, an increase of the fine chemical, preferably of free campesterol between 22% and 285% or more is conferred In case the activity of the *Saccharomyces cerevisiae* protein YLR027C or its homologs, e.g. a "aspartate aminotransferase" is increased, advantageously in an organelle such as a plastid or mitochondria, preferably, an increase of the fine chemical, preferably of free beta-sitosterol between 24% and 219% or more is conferred In case the activity of the *Saccharomyces cerevisiae* protein YLR027C or its homologs, e.g. a "aspartate aminotransferase" is increased, advantageously in an organelle such as a plastid or mitochondria, preferably, an increase of the fine chemical, preferably of free campesterol between 22% and 285% or more and free beta-sitosterol between 24% and 219% or more is conferred In case the activity of the *Saccharomyces cerevisiae* protein YNL241C or its homologs, e.g. a "glucose-6-phosphate dehydrogenase" is increased, advantageously in an organelle such as a plastid or mitochondria, preferably, an increase of the fine chemical, preferably of free campesterol between 21% and 31% or more is conferred In one embodiment, the activity of the *Escherichia coli* protein b0931 or its homologs, e.g. a "nicotinate phosphoribosyltransferase" is advantageously increased in an organelle such as a plastid or mitochondria, preferably conferring an increase of the fine chemical beta-sitosterol indicated in column 6 "metabolites" for application no. 13 in any one of Tables I to IV.

In one embodiment, the activity of the *Escherichia coli* protein b1410 or its homologs, e.g. a "putative methylase with S-adenosyl-L-methionine-dependent methyl-transferase domain and alpha/beta-hydrolase domain" is advantageously increased in an organelle such as a plastid or mitochondria, preferably conferring an increase of the fine chemical beta-sitosterol and/or campesterol as indicated in column 6 "metabolites" for application no. 13 in any one of Tables I to IV In one embodiment, the activity of the *Escherichia coli* protein b1556 or its homologs, e.g. a "Qin prophage" is advantageously increased in an organelle such as a plastid or mitochondria, preferably conferring an increase of the fine chemical campesterol as indicated in column 6 "metabolites" for application no. 13 in any one of Tables I to IV In one embodiment, the activity of the *Escherichia coli* protein b1704 or its homologs, e.g. a "3-deoxy-D-arabino-heptulosonate-7-phosphate synthase (DAHP synthetase), tryptophan-repressible" is advantageously increased in an organelle such as a plastid or mitochondria, preferably conferring an increase of the fine chemical stigmasterol as indicated in column 6 "metabolites" for application no. 13 in any one of Tables I to IV In one embodiment, the activity of the *Escherichia coli* protein b2022 or its homologs, e.g. a "bifunctional histidinol-phosphatase/imidazoleglycerol-phosphate dehydratase" is advantageously increased in an organelle such as a plastid or mitochondria, preferably conferring an increase of the fine chemical campesterol as indicated in column 6 "metabolites" for application no. 13 in any one of Tables I to IV In one embodiment, the activity of the *Escherichia coli* protein b3708 or its homologs, e.g. a "tryptophan deaminase, PLP-dependent" is advantageously increased in an organelle such as a plastid or mitochondria, preferably conferring an increase of the fine chemical campesterol as indicated in column 6 "metabolites" for application no. 13 in any one of Tables I to IV In one embodiment, the activity of the *Saccharomcyes cerevisiae* protein YDR035w or its homologs, e.g. a "3-deoxy-D-arabino-heptulosonate 7-phosphate (DAHP) synthase" is advantageously increased in an organelle such as a plastid or mitochondria, preferably conferring an increase of the fine chemical beta-sitosterol and/or campesterol as indicated in column 6 "metabolites" for application no. 13 in any one of Tables I to IV In one embodiment, the activity of the *Saccharomcyes cerevisiae* protein YLR027c or its homologs,e.g. a "aspartate aminotransferase" is advantageously increased in an organelle such as a plastid or mitochondria, preferably conferring an increase of the fine chemical beta-sitosterol and/or campesterol as indicated in column 6 "metabolites" for application no. 13 in any one of Tables I to IV In one embodiment, the activity of the *Saccharomcyes cerevisiae* protein YNL241c or its homologs, e.g. a "glucose-6-phosphate dehydrogenase" is advantageously increased in an organelle such as a plastid or mitochondria, preferably conferring an increase of the fine chemical campesterol as indicated in column 6 "metabolites" for application no. 13 in any one of Tables I to IV for the disclosure of the paragraphs [0061.0.0.12] and [0062.0.0.12] see paragraphs [0061.0.0.0] and [0062.0.0.0] above.

A protein having an activity conferring an increase in the amount or level of the fine chemical, preferably upon targeting to the plastids, has in one embodiment the structure of the polypeptide described herein, in particular of the polypeptides comprising the consensus sequence shown in table IV, application no. 13, column 7 or of the polypeptide as shown in the amino acid sequences as disclosed in table II, application no. 13, columns 5 and 7 or the functional homologues thereof as described herein, or is encoded by the nucleic acid molecule characterized herein or the nucleic acid molecule according to the invention, for example by the nucleic acid molecule as shown in table I, application no. 13, columns 5 and 7 or its herein described functional homologues and has the herein mentioned activity.

For the purposes of the present invention, the reference to the fine chemical, e.g. to the term "sterols", also encompasses the corresponding salt, ester, e.g. the mono- or diesters of fatty acids, e.g. sterols dipalmitates, dimyristates or monomyristates, or sterols bound to proteins, e.g. lipoproteins or e.g. tuberlin, or bound to other compounds.

Sterols exist in a matrix in foods. Thus, in one embodiment, the fine chemical produced according to the process of the invention is a matrix comprising inter alia lipids, in particular cholesterol, phospholipid, and/or triglycerides, and sterols.

for the disclosure of the paragraphs [0065.0.0.12] and [0066.0.0.12] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 13, columns 5 and 7 or its homologs activity having herein-mentioned sterol increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 13, columns 5 and 7, e.g. a nucleic acid sequence encoding a polypeptide having the activity of a protein as indicated in table II, application no. 13, columns 5 and 7 or its homologs activity or of a mRNA encoding the polypeptide of the present invention having herein-mentioned sterol increasing activity; and/or c) increasing the specific activity of a protein conferring the increased expression of a protein encoded by the nucleic acid molecule of the invention or of the polypeptide of the present invention having herein-mentioned sterol increasing activity, e.g. of a polypeptide having the activity of a protein as indicated in table II, application no. 13, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned sterol increasing activity, e.g. of a polypeptide having the activity of a protein as indicated in table II, application no. 13, columns 5 and 7 or its homologs activity; and/or e) stimulating activity of a protein conferring the increased expression of a protein encoded by the nucleic acid molecule of the present invention or a polypeptide of the present invention having herein-mentioned sterol increasing activity, e.g. of a polypeptide having the activity of a protein as indicated in table II, application no. 13, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned sterol increasing activity, e.g. of a polypeptide having the activity of a protein as indicated in table II, application no. 13, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned sterol increasing activity, e.g. of a polypeptide having the activity of a protein as indicated in table II, application no. 13, columns 5 and 7 or its homologs activity; and/or h) increasing the expression of the endogenous gene encoding the polypeptide of the invention, e.g. a polypeptide having the activity of a protein as indicated in table II, application no. 13, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned sterol increasing activity, e.g. of polypeptide having the activity of a protein as indicated in table II, application no. 13, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned sterol increasing activity, e.g. of a polypeptide having the activity of a protein as indicated in table II, application no. 13, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned sterol increasing activity, e.g. of a polypeptide having the activity of a protein as indicated in table II, application no. 13, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the respective fine chemical as indicated in column 6 of application no. 13 in Table I to IV, resp., after increasing the expression or activity of the encoded polypeptide preferably in organelles such as plastids or having the activity of a polypeptide having an activity as the protein as shown in table II, application no. 13, column 3 or its homologs. Preferably the increase of the fine chemical takes place in plastids.

for the disclosure of the paragraphs [0069.0.0.12] to [0079.0.0.12] see paragraphs [0069.0.0.0] to [0079.0.0.0] above.

The activation of an endogenous polypeptide having above-mentioned activity, e.g. having the activity of a protein as shown in table II, application no. 13, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 13, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 13, column 3. The expression of the chimeric transcription factor in a organism, in particular in a plant, leads to a specific expression of the protein as shown in table II, application no. 13, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

For the disclosure of the paragraphs [0081.0.0.12] to [0084.0.0.12] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous sterols containing composition comprising a higher content of (from a viewpoint of nutritional physiology limited), sterols or phytosterol(s), in particular campesterol, beta-sitosterol or stigmasterol, e.g. in combination with fatty acid(s), dietary oil(s), such as corn oil, and/or triglycerides, in particular medium-chain (e.g. $C_4$ to $C_{18}$—, in particular $C_6$ to $C_{14}$—) triglycerides, lipoproteins, e.g. HDL and/or VLDL, micelles, clathrate complexes, e.g. conjugated with bile salts, chylomicrons, chylomicron remnants, tuberlin and/or sterols It can also be advantageous to increase the level of a metabolic precursor of sterols in the organism or part thereof.

Depending on the choice of the organism used for the process according to the present invention, for example a microorganism or a plant, compositions or mixtures of various sterols can be produced.

for the disclosure of this paragraph see paragraph [0086.0.0.0] above.

By influencing the metabolism thus, it is possible to produce, in the process according to the invention, further advantageous compounds. Examples of such compounds are in addition to phytosterols further sterols, stanols or squalene, squalene epoxide or cycloartenol.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 13, column 3 or of a polypeptide being encoded by the nucleic acid molecule of the present invention and described below, e.g. conferring an increase of the respective fine chemical as indicated in any one of Tables I to IV, application no. 13, column 6 "metabolite" in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and d) if desired, recovering, optionally isolating, the respective free and/or bound the fine chemical as indicated in any one of Tables I to IV, application no. 13, column 6 "metabolite" and, optionally further free and/or boundsterols, in particular stigmasterol, beta-sitosterol or campesterol, synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the respective fine chemical but as option it is also possible to produce, recover and, if desired isolate, other free or/and bound sterols, in particular stigmasterol, beta-sitosterol or campesterol.

The organism such as microorganisms or plants or the recovered, and if desired isolated, respective fine chemical can then be processed further directly into foodstuffs or animal feeds or for other applications, for example according to the disclosures made in:

US 20040101829, which disclose a methods for treating hyperlipidemia and to reduce Low Density Lipoprotein ("LDL") levels in a subject, US 20040047971, which disclose the preparation of a fat composition containing sterol esters characterised by direct interesterification of sterol with triglyceride, U.S. Pat. No. 5,965,449, which describes phytosterol-based compositions useful in preventing and treating cardiovascular disease and other disorders, U.S. Pat. No. 5,523,087, which is for a pharmaceutical composition containing beta-sitosterol for the treatment of diabetic male sexual dysfunction;

U.S. Pat. No. 5,747,464, which discloses a composition for inhibiting absorption of fat and cholesterol from the gut comprising beta.-sitosterol bound irreversibly to pectin, U.S. Pat. No. 4,588,717, which describes a vitamin supplement which comprises a fatty acid ester of a phytosterol, U.S. Pat. No. 5,270,041, which teaches the use of small amounts of sterols, their fatty acid esters and glucosides for the treatment of tumours, U.S. Pat. No. 6,087,353, which comprises methods of making a composition suitable for incorporation into foods, beverages, pharmaceuticals, nutraceuticals and the like which comprises condensing a suitable aliphatic acid with a phytosterol to form a phytosterol ester and subsequently hydrogenating the phytosterol ester to form a hydrogenated phytosterol ester, which are expressly incorporated herein by reference.

The fermentation broth, fermentation products, plants or plant products can be treated with water and a mixture of organic solvents (hexane and acetone) in order to extract the phytosterols. Crude phytosterols are obtained from the organic phase by removal of the solvents, complexation of the sterols in the extract with calcium chloride in methanol, separation of the sterol-complexes by centrifugation, dissociation of the complexes by heating in water and removal of the water. The crude phytosterols can be further purified by crystallisation from isopropanol. According to an other production process the tall oil soap is first subjected to fractional distillation which removes volatile compounds. The resulting residue (tall oil pitch) containing sterols in esterified form is treated with alkali to liberate these sterols. After neutralisation, the material is subjected to a two-stage distillation process. The distillate is then dissolved in methanol/methylethylketone solvent and the sterols crystallizing from this solution are obtained by filtration, washed with solvent and dried. U.S. Pat. No. 4,420,427 teaches the preparation of sterols from vegetable oil sludge using solvents such as methanol. Alternatively, phytosterols may be obtained from tall oil pitch or soap, by-products of the forestry practise as described in PCT/CA95/00555, incorporated herein by reference. The extraction and crystallization may be performed by other methods known to the person skilled in the art and described herein below. To form a phytosterol ester in accordance with the U.S. Pat. No. 6,087,353, the selected phytosterol and aliphatic acid or its ester with volatile alcohol are mixed together under reaction conditions to permit condensation of the phytosterol with the aliphatic acid to produce an ester. A most preferred method of preparing these esters which is widely used in the edible fat and oil industry is described in U.S. Pat. No. 5,502,045 (which is incorporated herein by reference). The stanol and/or sterol esters with the desired fatty acid composition can also be produced by direct, preferably catalytic esterification methods, e.g. U.S. Pat. No. 5,892,068, between free fatty acids or fatty acid blends of the composition and the stanol and/or sterol. In addition, stanol and/or sterol esters can also be produced by enzymatic esterification e.g. as outlined in EP 195 311 (which are incorporated herein by reference).

Products of these different work-up procedures are phytosterols and/or esters and/or conjugates or compositions which still comprise fermentation broth, plant particles and cell components in different amounts, advantageously in the range of from 0 to 99% by weight, preferably below 80% by weight, especially preferably between below 50% by weight.

for the disclosure of the paragraphs [0090.0.0.12] to [0097.0.0.12] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 13, columns 5 and 7 or a derivative thereof, or b) a genetic regulatory element, for example a promoter, which is functionally linked to the nucleic acid sequence as shown table I, application no. 13, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 13, columns 5 and 7 joined to a nucleic acid sequence encoding a transit peptide, or a targeting nucleic acid sequence which directs the nucleic acid sequences disclosed in table I, application no. 13, columns 5 and 7 to the organelle preferentially the plastids. Altenatively the inventive nucleic acids sequences consist advantageously of the nucleic acid sequences as depicted in the sequence protocol and disclosed in table I, application no. 13, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

Transgenic plants which comprise the phytosterol (preferably beta-sitosterol and/or stigmasterol and/or campesterol) synthesized in the process according to the invention can advantageously be marketed directly without there being any need for the phytosterols (preferably beta-sitosterol and/or campesterol and/or stigmasterol) (oils, lipids or fatty acids synthesized) to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue. However, the respective fine chemical produced in the process according to the invention can also be isolated from the organisms, advantageously plants, in the form of their oils, fats, lipids, esters and/or as extracts, e.g. ether, alcohol, or other organic solvents or water containing extract and/or free phytosterol(s). The respective fine chemical produced by this process can be obtained by harvesting the organisms, either from the crop in which they grow, or from the field. This can be done via pressing or extraction of the plant parts, preferably the plant seeds. To increase the efficiency of extraction it is beneficial to clean, to temper and if necessary to hull and to flake the plant material especially the seeds. In this context, the oils, fats, lipids, esters and/or free phytosterols can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid.

Plant sterols (phytosterols) are by-products of traditional vegetable oil refining. The source may be commonly a blend of crude edible oils, consisting of soy bean oil or of other edible oils, e.g. corn, rapeseed, olive and palm oil in varying proportions. Hemp may also be a source of new oilseed, oil and food ingredients as well as Sea buckthorn (hippophaë rhamnoides). The crude oil, which is obtained by pressing or solvent extraction, may undergoes a series of refining processes to remove solvents, lecithins, free fatty acids, color bodies, off-odors and off-flavors. In one of these steps, the oil may be subjected to steam distillation at reduced pressure (deodorisation) and the resulting distillate contains the phytosterol fraction. From this fraction, fatty acids, lecithins and other compounds are removed by fractional distillation, ethanolysis/transesterification, distillation and crystallisation from a heptane solution, and the phytosterols are further purified by recrystallisation using food grade materials and good manufacturing practices. The extraction and purification steps are standard methods and similar to the procedures used traditionally by the food industry for the production of plant sterols. Phytosterol esters may be produced from the sterols using food grade vegetable oil-derived fatty acids or triglycerides and applying standard methods for esterification or transesterification commonly used in the fats and oils industry.

Phytosterol in microorganisms may be localized intracellularly, therefor their recovery essentials comes down to the isolation of the biomass. Well-establisthed approaches for the harvesting of cells include filtration, centrifugation and coagulation/flocculation as described herein. Determination of tocopherols in cells has been described by Tan and Tsumura 1989, see also Biotechnology of Vitamins, Pigments and Growth Factors, Edited by Erik J. Vandamme, London, 1989, p.96 to 103. Many further methods to determine the tocopherol content are known to the person skilled in the art.

In an advantageous embodiment of the invention, the organism takes the form of a plant whose sterol content is modified advantageously owing to the nucleic acid molecule of the present invention expressed. This is important for plant breeders since, for example, the nutritional value of plants for poultry is dependent on the abovementioned sterols in feed. Further, this is also important for the production of cosmetic compostions.

In another advantageous embodiment of the invention, the organism takes the form of a plant whose sterol content is modified advantageously owing to the nucleic acid molecule of the present invention expressed. This is important for plant breeders since, for example, the nutritional value of plants for poultry is dependent on the abovementioned sterols and the general amount of sterols as source in feed and/or food.

Further, this is also important since, for example a balanced content of different sterols induces stress resistance to plants.

After the activity of the protein as shown in table II, application no. 13, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.12] to [0110.0.0.12] see paragraphs [0102.0.0.0] to [0110.0.0.0] above.

In a preferred embodiment, the respective fine chemical as indicated in any one of Tables I to IV, application no. 13, column 6 "metabolite" (sterols) is produced in accordance with the invention and, if desired, is isolated. The production of further vitamins, provitamins or carotenoids, e.g. carotenes or xanthophylls, or mixtures thereof or mixtures with other compounds by the process according to the invention is advantageous.

Thus, the content of plant components and preferably also further impurities is as low as possible, and the abovementioned sterols are obtained in as pure form as possible. In these applications, the content of plant components advantageously amounts to less than 10%, preferably 1%, more preferably 0.1%, very especially preferably 0.01% or less.

In another preferred embodiment of the invention a combination of the increased expression of the nucleic acid sequence or the protein of the invention together with the transformation of a protein or polypeptide or a compound, which functions as a sink for the desired fine chemical, for example sterols in the organism, is useful to increase the production of the respective fine chemical (as indicated in any one of Tables I to IV, application no. 13, column 6 "metabolite").

In the case of the fermentation of microorganisms, the above-mentioned sterols may accumulate in the medium and/or the cells. If microorganisms are used in the process according to the invention, the fermentation broth can be processed after the cultivation. Depending on the requirement, all or some of the biomass can be removed from the fermentation broth by separation methods such as, for exampie, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, spray granulation or by other methods. Preferably the respective fine chemical as indicated for application no. 13 in any one of Tables I to IV, column 6 "metabolite" or the sterols comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the sterols (preferably betasitosterol and/or campesterol an/or stigmasterol), synthesized in the process according to the invention can advantageously be marketed directly without there being any need for sterols synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue. The site of sterol biosynthesis in plants is, inter alia, the leaf tissue so that the isolation of leafs makes sense. However, this is not limiting, since the expression may also take place in a tissue-specific manner in all of the remaining parts of the plant, in particular in fat-containing seeds. A further preferred embodiment therefore relates to a seed-specific isolation of sterols.

However, the respective fine chemical as indicated for application no. 13 in any one of Tables I to IV, column 6, "metabolite" produced in the process according to the invention can also be isolated from the organisms, advantageously plants, in the form of their oils, fats, lipids as extracts, e.g. ether, alcohol, or other organic solvents or water containing extract and/or free sterols. The respective fine chemical produced by this process can be obtained by harvesting the organisms, either from the crop in which they grow, or from the field. This can be done via pressing or extraction of the plant parts, preferably the plant seeds. To increase the efficiency of oil extraction it is beneficial to clean, to temper and if necessary to hull and to flake the plant material especially the seeds. e.g. the oils, fats, lipids, extracts, e.g. ether, alcohol, or other organic solvents or water containing extract and/or free sterols can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as preferably warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid.

Plant sterols (phytosterols) are by-products of traditional vegetable oil refining. The source may be commonly a blend of crude edible oils, consisting of soy bean oil or of other edible oils, e.g. corn, rapeseed, olive and palm oil in varying proportions. Hemp may also be a source of new oilseed, oil and food ingredients as well as Sea buckthorn (hippophaë rhamnoides). The crude oil, which is obtained by pressing or solvent extraction, may undergoes a series of refining processes to remove solvents, lecithins, free fatty acids, color bodies, off-odors and off-flavors. In one of these steps, the oil may be subjected to steam distillation at reduced pressure (deodorisation) and the resulting distillate contains the phytosterol fraction. From this fraction, fatty acids, lecithins and other compounds are removed by fractional distillation, ethanolysis/transesterification, distillation and crystallisation from a heptane solution, and the phytosterols are further purified by recrystallisation using food grade materials and good manufacturing practices. The extraction and purification steps are standard methods and similar to the procedures used traditionally by the food industry for the production of plant sterols. Phytosterol esters may be produced from the sterols using food grade vegetable oil-derived fatty acids or triglycerides and applying standard methods for esterification or transesterification commonly used in the fats and oils industry.

Because sterols in microorganisms may be localized intracellularly, their recovery essentially comes down to the isolation of the biomass. Well-established approaches for the harvesting of cells include filtration, centrifugation and coagulation/flocculation as described herein.

Sterols can for example be analyzed advantageously via HPLC, LC or GC separation methods and detected by MS oder MSMS methods. The unambiguous detection for the presence of sterols containing products can be obtained by analyzing recombinant organisms using analytical standard methods: GC, GC-MS, or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). The material to be analyzed can be disrupted by sonication, grinding in a glass mill, liquid nitrogen and grinding, cooking, or via other applicable methods; see also Biotechnology of Vitamins, Pigments and Growth Factors, Edited by Erik J. Vandamme, London, 1989, p. 96 to 103.

In a preferred embodiment, the present invention relates to a process for the production of the respective fine chemical as indicated for application no. 13 in any one of Tables I to IV, column 6 "metabolite", comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 13, columns 5 and 7 or a fragment thereof, which confers an increase in the amount of the respective fine chemical in an organism or a part thereof;

b) nucleic acid molecule comprising, preferably at least the mature form, of the nucleic acid molecule shown in table I, application no. 13, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybidizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;

h) nucleic acid molecule comprising a nucleic acid molecule which is obtained by amplifying nucleic acid molecules from a cDNA library or a genomic library using the primers shown in table III, application no. 13, column 7 and conferring an increase in the amount of the respective fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;

j) nucleic acid molecule which encodes a polypeptide comprising the consensus sequence shown in table IV, application no. 13, column 7 and conferring an increase in the amount of the respective fine chemical in an organism or a part thereof;

k) nucleic acid molecule comprising one or more of the nucleic acid molecule encoding the amino acid sequence of a polypeptide encoding a domain of the polypeptide shown in table II, application no. 13, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in table IA, application no. 13, columns 5 and 7 by one or more nucleotides. In one embodiment, the nucleic acid molecule used in the process of the invention does not consist of the sequence indicated in table IA, application no. 13, columns 5 and 7. In one embodiment, the nucleic acid molecule used in the process of the invention is less than 100%, 99.999%, 99.99%, 99.9% or 99% identical to a sequence indicated in table IA, application no. 13, columns 5 and 7. In another embodiment, the nucleic acid molecule does not encode a polypeptide of a sequence indicated in table IIA, application no. 13, columns 5 and 7.

In one embodiment, the nucleic acid molecule used in the process of the invention distinguishes over the sequence indicated in table IB, application no. 13, columns 5 and 7, by one or more nucleotides. In one embodiment, the nucleic acid molecule used in the process of the invention does not consist of the sequence indicated in table IB, application no. 13, columns 5 and 7. In one embodiment, the nucleic acid molecule used in the process of the invention is less than 100%, 99.999%, 99.99%, 99.9% or 99% identical to a sequence indicated in table IB, application no. 13, columns 5 and 7. In another embodiment, the nucleic acid molecule does not encode a polypeptide of a sequence indicated in table IIB, application no. 13, columns 5 and 7.

In one embodiment, the nucleic acid molecule used in the process distinguishes over the sequence shown in table I, application no. 13, columns 5 and 7 by one or more nucleotides or does not consist of the sequence shown in table I, application no. 13, columns 5 and 7. In one embodiment, the nucleic acid molecule of the present invention is less than 100%, 99.999%, 99.99%, 99.9% or 99% identical to the sequence shown in table I, application no. 13, columns 5 and 7. In another embodiment, the nucleic acid molecule does not encode a polypeptide of the sequence shown in table II, application no. 13, columns 5 and 7.

for the disclosure of the paragraphs [0118.0.0.12] to [0120.0.0.12] see paragraphs [0118.0.0.0] to [0120.0.0.0] above.

The expression of nucleic acid molecules with the sequence shown in table I, application no. 13, columns 5 and 7, or nucleic acid molecules which are derived from the amino acid sequences shown in table II, application no. 13, columns 5 and 7 or from polypeptides comprising the consensus sequence shown in table IV, application no. 13, column 7, or their derivatives or homologues encoding polypeptides with the enzymatic or biological activity of a protein as shown in table II, application no. 13, column 3, and conferring an increase of the respective fine chemical (column 6 of application no. 13 in any one of Tables I to IV) after increasing its plastidic expression and/or specific activity in the plastids is advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 13, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 13, column 3 and which confer an increase in the level of the respective fine chemical indicated in table II, application no. 13, column 6 by being expressed either in the cytsol or in an organelle such as a plastid or mitochondria or both, preferably in plastids, and the gene product being localized in the plastid and other parts of the cell or in the plastid as described above.

for the disclosure of the paragraphs [0126.0.0.12] to [0133.0.0.12] see paragraphs [0126.0.0.0] to [0133.0.0.0] above.

Production strains which are also advantageously selected in the process according to the invention are microorganisms selected from the group of green algae, like *Spongioccocum exentricum, Chlorella sorokiniana* (pyrenoidosa, Jul. 11, 2005), or algae of the genus *Haematococcus, Phaedactylum tricornatum, Volvox* or *Dunaliella* or form the group of fungi like fungi belonging to the Daccrymycetaceae family, or non-photosynthetic bacteria, like methylotrophs, flavobacteria, actinomycetes, like streptomyces chrestomyceticus, Mycobacteria like *Mycobacterim phlei, Rhodobacter capsulatus*, or *Brevibacterium linens, Dunaliella* spp., *Phaffia rhodozyma, Phycomyces* sp., *Rhodotorula* spp. Thus, the invention also contemplates embodiments in which a host lacks sterols or sterols precursors, such as the vinca. In a plant of the latter type, the inserted DNA includes genes that code for proteins producing sterols precursors (compounds that can be converted biologically into a compound with sterols activity) and one or more modifiying enzymes which were originally absent in such a plant.

The invention also contemplates embodiments in which the sterols or sterols precursor compounds in the production of the respective fine chemical, are present in a photosynthetic active organisms chosen as the host; for example, cyanobacteria, moses, algae or plants which, even as a wild type, are capable of producing sterols.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 13, columns 5 and 7 or the functional homologues thereof as described herein, preferably conferring above-mentioned activity, i.e. conferring an increase of the respective fine chemical after increasing its plastidic activity, e.g. after increasing the activity of a protein as shown in table II, application no. 13, column 3 by—for example— expression either in the cytsol or in an organelle such as a plastid or mitochondria or both, preferably in plastids and the gene product, e.g. the polypeptide, being localized in the plastid and other parts of the cell or in the plastid as described above.

for the disclosure of the paragraphs [0135.0.0.12] to [0140.0.0.12] see paragraphs [0135.0.0.0] to [0140.0.0.0] above.

Synthetic oligonucleotide primers for the amplification, e.g. as shown in table III, application no. 13, column 7, by means of polymerase chain reaction can be generated on the basis of a sequence shown herein, for example the sequence shown in table I, application no. 13, columns 5 and 7 or the sequences derived from table II, application no. 13, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequences shown in table IV, application no. 13, column 7 are derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 13, column 3 or further functional homologs of the polypeptide of the invention from other organisms.

for the disclosure of the paragraphs [0144.0.0.12] to [0151.0.0.12] see paragraphs [0144.0.0.0] to [0151.0.0.0] above.

Polypeptides having above-mentioned activity, i.e. conferring the increase of the respective fine chemical indicated in table I, application no. 13, column 6, and being derived from other organisms, can be encoded by other DNA sequences which hybridize to the sequences shown in table I, application no. 13, columns 5 and 7, preferably of table IB, application no. 13, columns 5 and 7 under relaxed hybridization conditions and which code on expression for peptides having the respective fine chemical, i.e. sterols increasing activity, when expressed in a way that the gene product, e.g. the polypeptide, being localized in the plastid and other parts of the cell or in the plastid as described above.

For the disclosure of the paragraphs [0153.0.0.12] to [0159.0.0.12] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 13, columns 5 and 7, preferably shown in table IB, application no. 13, columns 5 and 7 is one which is sufficiently complementary to one of the nucleotide sequences shown in table I, application no. 13, columns 5 and 7, preferably shown in table IB, application no. 13, columns 5 and 7 such that it can hybridize to one of the nucleotide sequences shown in table I, application no. 13, columns 5 and 7, preferably shown in table IB, application no. 13, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 13, columns 5 and 7, preferably shown in table IB, application no. 13, columns 5 and 7, or a portion thereof and preferably has above mentioned activity, in particular having a respective fine chemical increasing activity after increasing the activity or an activity of a gene product as shown in table II, application no. 13, column 3 by for example expression either in the cytsol or in an organelle such as a plastid or mitochondria or both, preferably in plastids, and the gene product, e.g. the polypeptide, being localized in the plastid and other parts of the cell or in the plastid as described above.

The nucleic acid molecule of the invention comprises a nucleotide sequence which hybridizes, preferably hybridizes under stringent conditions as defined herein, to one of the nucleotide sequences shown in table I, application no. 13, columns 5 and 7, preferably shown in table IB, application no. 13, columns 5 and 7, or a portion thereof and encodes a protein having above-mentioned activity, e.g. conferring of a sterol or triglycerides, lipids, oils and/or fats containing sterol increase by for example expression either in the cytsol or in an organelle such as a plastid or mitochondria or both, preferably in plastids, and optionally, the activity of a protein as shown in table II, application no. 13, column 3, and the gene product, e.g. the polypeptide, being localized in the plastid and other parts of the cell or in the plastid as described above.

Moreover, the nucleic acid molecule of the invention can comprise only a portion of the coding region of one of the sequences shown in table I, application no. 13, columns 5 and 7, preferably shown in table IB, application no. 13, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the respective fine chemical indicated in Table I, application no. 13, column 6, if its activity is increased by for example expression either in the cytsol or in an organelle such as a plastid or mitochondria or both, preferably in plastids, and the gene product, e.g. the polypeptide, being localized in the plastid and other parts of the cell or in the plastid as described above. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 13, columns 5 and 7, an anti-sense sequence of one of the sequences, e.g., set forth in table I, application no. 13, columns 5 and 7, preferably shown in table IB, application no. 13, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 13, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 13, columns 5 and 7 such that the protein or portion thereof maintains the ability to participate in the fine chemical production, in particular an activity increasing the level of sterol increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 13, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 13, columns 5 and 7 and having above-mentioned activity, e.g. conferring preferably the increase of the respective fine chemical by for example expression either in the cytsol or in an organelle such as a plastid or mitochondria or both, preferably in plastids, and the gene product, e.g. the polypeptide, being localized in the plastid and other parts of the cell or in the plastid as described above.

for the disclosure of the paragraphs [0168.0.0.12] and [0169.0.0.12] see paragraphs [0168.0.0.0] and [0169.0.0.0] above.

The invention further relates to nucleic acid molecules that differ from one of the nucleotide sequences shown in table I, application no. 13, columns 5 and 7 (and portions thereof) due to degeneracy of the genetic code and thus encode a polypeptide of the present invention, in particular a polypeptide having above mentioned activity, e.g. conferring an increase in the respective fine chemical in a organism, e.g. as that polypeptides depicted by the sequence shown in table II, application no. 13, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 13, columns 5 and 7 or the functional homologues. In a still further embodiment, the nucleic acid molecule of the invention encodes a full length protein which is substantially homologous to an amino acid sequence shown in table II, application no. 13, columns 5 and 7 or the functional homologues. However, in a preferred embodiment, the nucleic acid molecule of the present invention does not consist of the sequence shown in table I, application no. 13, columns 5 and 7, preferably as indicated in table IA, application no. 13, columns 5 and 7. Preferably the nucleic acid molecule of the invention is a functional homologue or identical to a nucleic acid molecule indicated in table IB, application no. 13, columns 5 and 7.

for the disclosure of the paragraphs [0171.0.0.12] to [0173.0.0.12] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 13, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 13, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 13, columns 5 and 7.

For the disclosure of the paragraphs [0179.0.0.12] and [0180.0.0.12] see paragraphs [0179.0.0.0] and [0180.0.0.0] above.

Accordingly, the invention relates to nucleic acid molecules encoding a polypeptide having above-mentioned activity, e.g. conferring an increase in the respective fine chemical in an organisms or parts thereof by for example expression either in the cytsol or in an organelle such as a plastid or mitochondria or both, preferably in plastids (as described), that contain changes in amino acid residues that are not essential for said activity. Such polypeptides differ in amino acid sequence from a sequence contained in the sequences shown in table II, application no. 13, columns 5 and 7, preferably shown in table IIA, application no. 13, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 13, columns 5 and 7, preferably shown in table IIA, application no. 13, columns 5 and 7 and is capable of participation in the increase of production of the fine chemical after increasing its activity, e.g. its expression by for example expression either in the cytsol or in an organelle such as a plastid or mitochondria or both, preferably in plastids and the gene product, e.g. the polypeptide, being localized in the plastid and other parts of the cell or in the plastid as described above. Preferably, the protein encoded by the nucleic acid molecule is at least about 60% identical to the sequence shown in table II, application no. 13, columns 5 and 7, preferably shown in table IIA, application no. 13, columns 5 and 7, more preferably at least about 70% identical to one of the sequences shown in table II, application no. 13, columns 5 and 7, preferably shown in table IIA, application no. 13, columns 5 and 7, even more preferably at least about 80%, 90%, 95% homologous to the sequence shown in table II, application no. 13, columns 5 and 7, preferably shown in table IIA, application no. 13, columns 5 and 7, and most preferably at least about 96%, 97%, 98%, or 99% identical to the sequence shown in table II, application no. 13, columns 5 and 7, preferably shown in table IIA, application no. 13, columns 5 and 7.

for the disclosure of the paragraphs [0182.0.0.12] to [0188.0.0.12] see paragraphs [0182.0.0.0] to [0188.0.0.0] above.

Functional equivalents derived from one of the polypeptides as shown in table II, application no. 13, columns 5 and 7, preferably shown in table IIB, application no. 13, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 13, columns 5 and 7, preferably shown in table IIB, application no. 13, columns 5 and 7 resp., according to the invention and are distinguished by essentially the same properties as the polypeptide as shown in table II, application no. 13, columns 5 and 7, preferably shown in table IIB, application no. 13, columns 5 and 7.

Functional equivalents derived from the nucleic acid sequence as shown in table I, application no. 13, columns 5 and 7, preferably shown in table IB, application no. 13, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 13, columns 5 and 7, preferably shown in table IIB, application no. 13, columns 5 and 7 resp., according to the invention and encode polypeptides having essentially the same properties as the polypeptide as shown in table II, application no. 13, columns 5 and 7, preferably shown in table IIB, application no. 13, columns 5 and 7.

for the disclosure of this paragraph see paragraph [0191.0.0.0] above.

A nucleic acid molecule encoding an homologous to a protein sequence of table II, application no. 13, columns 5 and 7, preferably shown in table IIB, application no. 13, columns 5 and 7 resp., can be created by introducing one or more nucleotide substitutions, additions or deletions into a nucleotide sequence of the nucleic acid molecule of the present invention, in particular of table I, application no. 13, columns 5 and 7, preferably shown in table IB, application no. 13, columns 5 and 7 resp., such that one or more amino acid substitutions, additions or deletions are introduced into the encoded protein. Mutations can be introduced into the encoding sequences of table I, application no. 13, columns 5 and 7, preferably shown in table IB, application no. 13, columns 5 and 7 resp., by standard techniques, such as site-directed mutagenesis and PCR-mediated mutagenesis.

for the disclosure of the paragraphs [0193.0.0.12] to [0196.0.0.12] see paragraphs [0193.0.0.0] to [0196.0.0.0] above.

Homologues of the nucleic acid sequences used, with the sequence shown in table I, application no. 13, columns 5 and 7, preferably shown in table IB, application no. 13, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 13, columns 5 and 7, preferably shown in table IB, application no. 13, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 13, columns 5 and 7, preferably shown in table IB, application no. 13, columns 5 and 7. It is preferred that the nucleic acid molecule comprises as little as possible other nucleotides not shown in any one of table I, application no. 13, columns 5 and 7, preferably shown in table IB, application no. 13, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 13, columns 5 and 7, preferably shown in table IB, application no. 13, columns 5 and 7.

Also preferred is that the nucleic acid molecule used in the process of the invention encodes a polypeptide comprising the sequence shown in table II, application no. 13, columns 5 and 7, preferably shown in table IIB, application no. 13, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 13, columns 5 and 7, preferably shown in table IIB, application no. 13, columns 5 and 7.

In one embodiment, the nucleic acid molecule of the invention or used in the process encodes a polypeptide comprising the sequence shown in table II, application no. 13, columns 5 and 7, preferably shown in table IIB, application no. 13, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 13, columns 5 and 7, preferably shown in table IB, application no. 13, columns 5 and 7.

Polypeptides (=proteins), which still have the essential biological or enzymatic activity of the polypeptide of the present invention conferring an increase of the respective fine chemical indicated in column 6 of Table I, application no. 13, i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 13, columns 5 and 7 expressed under identical conditions.

Homologues of table I, application no. 13, columns 5 and 7 or of the derived sequences of table II, application no. 13, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.12] to [0215.0.0.12] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 13, columns 5 and 7, preferably in table IIB, application no. 13, columns 5 and 7; or a fragment thereof conferring an increase in the amount of the fine chemical according to table IIB, application no. 13, column 6 in an organism or a part thereof b) nucleic acid molecule comprising, preferably at least the mature form, of the nucleic acid molecule shown in table I, application no. 13, columns 5 and 7, preferably in table IB, application no. 13, columns 5 and 7 or a fragment thereof conferring an increase in the amount of the fine chemical according to table IIB, application no. 13, column 6 in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical according to table IIB, application no. 13, column 6 in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical according to table IIB, application no. 13, column 6 in an organism or a part thereof;

e) nucleic acid molecule which hybridizes with a nucleic acid molecule of (a) to (c) under stringent hybridisation conditions and conferring an increase in the amount of the fine chemical according to table IIB, application no. 13, column 6 in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical according to table IIB, application no. 13, column 6 in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical according to table IIB, application no. 13, column 6 in an organism or a part thereof;

h) nucleic acid molecule comprising a nucleic acid molecule which is obtained by amplifying a cDNA library or a genomic library using the primers in table III, application no. 13, column 7 and conferring an increase in the amount of the fine chemical according to table IIB, application no. 13, column 6 in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 13, column 7 and conferring an increase in the amount of the fine chemical in an organism or a part thereof;

k) nucleic acid molecule encoding the amino acid sequence of a polypeptide encoding a domain of the polypeptide shown in table II, application no. 13, columns 5 and 7 and conferring an increase in the amount of the fine chemical according to table IIB, application no. 13, column 6 in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 13, columns 5 and 7 or a nucleic acid molecule encoding, preferably at least the mature form of, the polypeptide shown in table II, application no. 13, columns 5 and 7, and conferring an increase in the amount of the fine chemical according to table IIB, application no. 13, column 6 in an organism or a part thereof; or which encompasses a sequence which is complementary thereto;

whereby, preferably, the nucleic acid molecule according to (a) to (l) distinguishes over the sequence depicted in table IA and/or IB, application no. 13, columns 5 and 7 by one or more nucleotides. In one embodiment, the nucleic acid molecule of the invention does not consist of the sequence shown in table IA and/or IB, application no. 13, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 13, columns 5 and 7. In a further embodiment the nucleic acid molecule does not encode the polypeptide sequence shown in table IIA and/or IIB, application no. 13, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 13, columns 5 and 7 does not encode a protein of the sequence shown in table IIA and/or IIB, application no. 13, columns 5 and 7. Accordingly, in one embodiment, the protein encoded by a sequence of a nucleic acid accoridng to (a) to (l) does not consist of the sequence shown in table IA and/or IB, application no. 13, columns 5 and 7. In a further embodiment, the protein of the present invention is at least 30% identical to protein sequence depicted in table IIA and/or IIB, application no. 13, columns 5 and 7 and less than 100%, preferably less than 99.999%, 99.99% or 99.9%, more preferably less than 99%, 985, 97%, 96% or 95% identical to the sequence shown in table IIA and/or IIB, application no. 13, columns 5 and 7.

For the disclosure of the paragraphs [0217.0.0.12] to [0226.0.0.12] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 13, columns 5 and 7 can be cloned 3'prime to the transitpeptide encoding sequence, leading to a functional preprotein, which is directed to the plastids and which means that the mature protein fulfills its biological activity.

For the disclosure of the paragraphs [0228.0.0.12] to [0239.0.0.12] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 13, columns 5 and 7 or its derivatives, it is advantageous additionally to express and/or mutate further genes in the organisms. It can be especially advantageously, if additionally at least one further gene of the sterol biosynthetic pathway, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the sequences shown in Table I, application no. 13, columns 5 and 7 with genes which generally support or enhances the growth or yield of the target organism, for example genes which lead to faster growth rate of microorganisms or genes which produces stress-, pathogen, or herbicide resistant plants.

In addition, it might be also advantageously to combine one or more of the sequences indicated in Table I, columns 5 or 7, application no. 13, with genes which modify plant architecture or flower development, in the way, that the plant either produces more flowers, or produces flowers with more petals in order to increase the respective fine chemical production capacity.

In a further embodiment of the process of the invention, therefore, organisms are grown, in which there is simultaneous direct or indirect overexpression of at least one nucleic acid or one of the genes which code for proteins involved in the sterol metabolism, in particular in synthesis of enzymes catalyzing the production of acetyl CoA_HMGCoA, mevalonate, mevalonate 5 phosphate, mevalonate 5-pyrophosphate, isopentyl diphosphate, 5-pyrophosphatemevalonate, isopentyl pyrophosphate (PIP), dimethylallyl pyrophosphate (DMAPP), PIP+DMAPP, geranyl pyrophosphate+IPP, farnesyl pyrophosphate, 2 farnesyl pyrophosphate, squalene (squalene synthase) and squalene epoxide, or cycloartenol synthase controlling the cyclization of squalene epoxide, S-adenosyl-L-methionine:sterol C-24 methyl transferase (EC 2.1.1.41) (SMT1) catalyzing the transfer of a methyl group from a cofactor, SMT2 catalyzing the second methyl transfer reaction, sterol C-14 demethylase catalyzing the demethylation at C-14, removing the methyl group and creating a double bond Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the above-mentioned biosynthesis genes are the sequences encoding further genes of the sterol biosynthetic pathway. These genes may lead to an increased synthesis of sterols, in particular of stigmasterol, beta-sitosterol or campestrol.

In a further advantageous embodiment of the process of the invention, the organisms used in the process are those in which simultaneously a sterol degrading protein is attenuated, in particular by reducing the rate of expression of the corresponding gene.

The respective fine chemical produced can be isolated from the organism by methods with which the skilled worker is familiar. For example, via extraction, salt precipitation, and/or different chromatography methods. The process according to the invention can be conducted batchwise, semibatchwise or continuously. The respective fine chemical produced by this process can be obtained by harvesting the organisms, either from the crop in which they grow, or from the field. This can be done via pressing or extraction of the plant parts.

For the disclosure of the paragraphs [0243.0.0.12] to [0264.0.0.12] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 13, columns 5 and 7 and described herein to achieve an expression in one of said compartments or extracellular.

For the disclosure of the paragraphs [0266.0.0.12] to [0287.0.0.12] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 13, columns 5 and 7 or their homologs is functionally linked to a plastidial targeting sequence. A further preferred embodiment of the invention relates to a vector in which a nucleic acid sequence encoding one of the polypeptides shown in table II, application no. 13, columns 5 and 7 or their homologs is functionally linked to a regulatory sequences which permit the expression in plastids.

For the disclosure of the paragraphs [0289.0.0.12] to [0296.0.0.12] see paragraphs [0289.0.0.0] to [0296.0.0.0] above.

Moreover, a native polypeptide conferring the increase of the respective fine chemical in an organism or part thereof can be isolated from cells (e.g., endothelial cells), for example using the antibody of the present invention as described herein, in particular, an antibody against polypeptides as shown in table II, application no. 13, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 13, columns 5 and 7 or as coded by the nucleic acid molecule shown in table I, application no. 13, columns 5 and 7 or functional homologues thereof.

In one advantageous embodiment, in the method of the present invention the activity of a polypeptide is increased comprising or consisting of the consensus sequence shown in table IV, application no. 13, columns 7 and in one another embodiment, the present invention relates to a polypeptide comprising or consisting of the consensus sequence shown in table IV, application no. 13, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

For the disclosure of the paragraphs [0301.0.0.12] to [0304.0.0.12] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 13, columns 5 and 7 by one or more amino acids. In one embodiment, polypeptide distinguishes form the sequence shown in table IIA and/or IIB, application no. 13, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 13, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 13, columns 5 and 7.

For the disclosure of this paragraph see paragraph [0306.0.0.0] above.

In one embodiment, the invention relates to polypeptide conferring an increase of level of the respective fine chemical indicated in Table IIA and/or IIB, application no. 13, column 6 in an organism or part being encoded by the nucleic acid molecule of the invention or used in the process of the invention and having a sequence which distinguishes from the sequence as shown in table IIA and/or IIB, application no. 13, columns 5 and 7 by one or more amino acids. In another embodiment, said polypeptide of the invention does not consist of the sequence shown in table IIA and/or IIB, application no. 13, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 13, columns 5 and 7.

In one embodiment, the present invention relates to a polypeptide having the activity of the protein as shown in table IIA and/or IIB, application no. 13, column 3, which distinguishes over the sequence depicted in table IIA and/or IIB, application no. 13, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle, for example into the plastid or mitochondria.

For the disclosure of the paragraphs [0309.0.0.12] to [0311.0.0.12] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 13, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 13, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 13, columns 5 and 7 or which is homologous thereto, as defined above.

Accordingly the polypeptide of the present invention can vary from the sequences shown in table IIA and/or IIB, application no. 13, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 13, columns 5 and 7.

For the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 13, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 13, column 3. Differences shall mean at least one amino acid different from the sequences as shown in table II, application no. 13, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 13, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 13, column 3. The nucleic acid molecules and polypeptide molecules of the invention are expressed such that the yield, production, and/or efficiency of production of a desired compound is improved.

Preferably, the compound is a composition comprising the essentially pure fine chemical, i.e. sterol or a recovered or isolated sterol in free or in protein- or membrane-bound form.

For the disclosure of the paragraphs [0320.0.0.12] to [0322.0.0.12] see paragraphs [0320.0.0.0] to [0322.0.0.0] above.

In one embodiment, a protein (=polypeptide) as shown in table II, application no. 13, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 13, column 3, e.g., a protein which does not confer the activity described herein and which is derived from the same or a different organism.

For the disclosure of the paragraphs [0324.0.0.12] to [0329.0.0.12] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 13, columns 5 and 7.

For the disclosure of the paragraphs [0331.0.0.12] to [0346.0.0.12] see paragraphs [0331.0.0.0] to [0346.0.0.0] above.

Accordingly the present invention relates to any cell transgenic for any nucleic acid characterized as part of the invention, e.g. conferring the increase of the respective fine chemical indicated in column 6 of application no. 13 in any one of Tables I to IV in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 13, column 3. Due to the above mentioned activity the respective fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 13, column 3 or a protein as shown in table II, application no. 13, column 3-like activity is increased in the cell or organism or part thereof especially in organelles such as plastids or mitochondria. Examples are described above in context with the process of the invention.

For the disclosure of this paragraph see paragraph [0348.0.0.0] above.

A naturally occurring expression cassette—for example the naturally occurring combination of the promoter of the gene encoding a protein as shown in table II, application no. 13, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

For the disclosure of the paragraphs [0350.0.0.12] to [0358.0.0.12] see paragraphs [0350.0.0.0] to [0358.0.0.0] above.

Transgenic plants comprising the respective fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The respective fine chemical indicated in column 6 of any one of Tables I to IV, application no. 13 and being produced in the process according to the invention may, however, also be isolated from the plant as one of the above mentioned derivates of sterols or the sterols itself, in particular betasitosterol and/or campesterol and/or stigmasterol resp., can be isolated by harvesting the plants either from the culture in which they grow or from the field. This can be done for example via expressing, grinding and/or extraction of the plant parts, preferably the plant seeds, plant fruits, plant tubers and the like.

for the disclosure of the paragraphs [0360.0.0.12] to [0362.0.0.12] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the respective fine chemical produced in the process can be isolated. The resulting composition or fraction comprising the respective fine chemical can, if appropriate, subsequently be further purified, if desired mixed with other active ingredients such as fatty acids, vitamins, amino acids, carbohydrates, antibiotics, covitamins, antioxidants, carotenoids, and the like, and, if appropriate, formulated.

In one embodiment, the composition is the fine chemical.

The fine chemical indicated in column 6 of application no. 13 in Table I, and being obtained in the process of the invention are suitable as starting material for the synthesis of further products of value. For example, they can be used in combination with each other or alone for the production of pharmaceuticals, foodstuffs, animal feeds or cosmetics. Accordingly, the present invention relates a method for the production of pharmaceuticals, food stuff, animal feeds, nutrients or cosmetics comprising the steps of the process according to the invention, including the isolation of a composition comprising the fine chemical, e.g. sterols or the isolated respective fine chemical produced, if desired, and formulating the product with a pharmaceutical acceptable carrier or formulating the product in a form acceptable for an application in agriculture. A further embodiment according to the invention is the use of the respective fine chemical indicated in application no. 13, Table I, column 6, and being produced in the process or the use of the transgenic organisms in animal feeds, foodstuffs, medicines, food supplements, cosmetics or pharmaceuticals.

for the disclosure of the paragraphs [0366.0.0.12] to [0369.0.0.12] see paragraphs [0366.0.0.0] to [0369.0.0.0] above.

The fermentation broths obtained in this way, containing in particular the respective fine chemical indicated in column 6 of any one of Tables I to IV; application no. 13 or containing mixtures with other compounds, in particular with vitamins or e.g. with carotenoids, e.g. with astaxanthin, or fatty acids or containing microorganisms or parts of microorganisms, like plastids, normally have a dry matter content of from 7.5 to 25% by weight. The fermentation broth can be processed further. Depending on requirements, the biomass can be separated, such as, for example, by centrifugation, filtration, decantation, coagulation/flocculation or a combination of these methods, from the fermentation broth or left completely in it. The fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction, freeze-drying, spray drying, spray granulation or by other processes.

As sterols are often localized in membranes or plastids, in one embodiment it is advantageous to avoid a leaching of the cells when the biomass is isolated entirely or partly by separation methods, such as, for example, centrifugation, filtration, decantation, coagulation/flocculation or a combination of these methods, from the fermentation broth. The dry biomass can directly be added to animal feed, provided the sterols concentration is sufficiently high and no toxic compounds are present. In view of the instability of sterols, conditions for drying, e.g. spray or flash-drying, can be mild and can be avoiding oxidation and cis/trans isomerization. For example antioxidants, e.g. BHT, ethoxyquin or other, can be added. In case the sterol concentration in the biomass is to dilute, solvent extraction can be used for their isolation, e.g. with alcohols, ether or other organic solvents, e.g. with methanol, ethanol, aceton, alcoholic potassium hydroxide, glycerol-phenol, liquefied phenol or for example with acids or bases, like trichloroacetatic acid or potassium hydroxide. A wide range of advantageous methods and techniques for the isolation of sterols can be found in the state of the art.

Accordingly, it is possible to further purify the produced sterols. For this purpose, the product-containing composition, e.g. a total or partial lipid extraction fraction using organic solvents, e.g. as described above, is subjected for example to a saponification to remove triglycerides, partition between e.g. hexane/methanol (seperation of non-polar epiphase from more polar hypophasic derivates) and separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.12] to [0376.0.0.12], [0376.1.0.12] and [0377.0.0.12] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting, e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 13, columns 5 and 7, preferably in table IB, application no. 13, columns 5 and 7, and, optionally, isolating the full length cDNA clone or complete genomic clone;
(c) introducing the candidate nucleic acid molecules in host cells, preferably in a plant cell or a microorganism, appropriate for producing the respective fine chemical;
(d) expressing the identified nucleic acid molecules in the host cells;
(e) assaying the respective fine chemical level in the host cells; and
(f) identifying the nucleic acid molecule and its gene product which expression confers an increase in the respective fine chemical as indicated for application no. 13 in any one of Tables I to IV level in the host cell after expression compared to the wild type.

for the disclosure of the paragraphs [0379.0.0.12] to [0383.0.0.12] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 13, column 3, e.g. comparing near identical organisms with low and high activity of the proteins as shown in table II, application no. 13, column 3.

for the disclosure of the paragraphs [0385.0.0.12] to [0404.0.0.12] see paragraphs [0385.0.0.0] to [0404.0.0.0] above.

Accordingly, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical indicated in Column 6, Table I, application no. 13 or for the production of the respective fine chemical and one or more other carotenoids, vitamins or fatty acids. In one embodiment, in the process of the present invention, the produced sterols are used to protect fatty acids against oxidization, e.g. it is in a further step added in a pure form or only partly isolated to a composition comprising fatty acids.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the respective fine chemical in a organism or part thereof, e.g. in a cell.

The nucleic acid molecule of the invention, the vector of the invention or the nucleic acid construct of the invention may also be useful for the production of organisms resistant to inhibitors of the sterol production biosynthesis pathways. In particular, the overexpression of the polypeptide of the present invention may protect an organism such as a microorganism or a plant against inhibitors, which block the phytosterol, in particular the respective fine chemical, synthesis in said organism. Examples of inhibitors or herbicides blocking the phytosterol synthesis in organism such as microorganism or plants are for example compounds which inhibit the cytochrom P450 such as Tetcyclasis, triazoles like Paclobutrazol or Epoxiconazol, pyridines like Obtusifoliol, demethylases inhibitors, or compounds like Mevilonin, which inhibits the HMG-CoA reductase.

In a further embodiment the present invention relates to the use of the antagonist of the present invention, the plant of the present invention or a part thereof, the microorganism or the host cell of the present invention or a part thereof for the production a cosmetic composition or a pharmaceutical composition. Such a composition has an antioxidative activity, photoprotective activity, can be used to protect, treat or heal the above mentioned diseases, e.g. hypercholesterolemic or cardiovascular diseases, certain cancers, and cataract formation or can be used as an immunostimulatory agent.

The sterols can be also used as stabilizer of other colours or oxygen sensitive compounds, like fatty acids, in particular unsaturated fatty acids.

for the disclosure of the paragraphs [0406.0.0.12] to [0416.0.0.12] see paragraphs [0406.0.0.0] to [0416.0.0.0] above.

An in vivo mutagenesis of organisms such as algae (e.g. *Spongiococcum* sp, e.g. *Spongiococcum exentricum*, *Chlorella* sp., *Haematococcus*, *Phaedactylum tricornatum*, *Volvox* or *Dunaliella*), *Synechocystis* sp. PCC 6803, *Physcometrella patens*, *Saccharomyces*, *Mortierella*, *Escherichia* and others mentioned above, which are beneficial for the production of sterols can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widely used as chemical agents for random in-vitro mutagensis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired fine chemical.

for the disclosure of the paragraphs [0418.0.0.12] to [0427.0.0.12] see paragraphs [0418.0.0.0] to [0427.0.0.0] above.

for the disclosure of the paragraphs [0427.1.9.12] see paragraphs [0428.1.9.9] above for the disclosure of the paragraphs [0427.2.9.12] see paragraph [0428.2.9.9] above for the disclosure of the paragraphs [0427.3.9.12] see paragraph [0428.3.9.9] above.

Sterols may be produced in *Synechocystis* spec. PCC 6803

The cells of each of independent *Synechocystis* spec. PCC 6803 strains cultured on the BG-11km agar medium, and untransformed wild-type cells (on BG11 agar medium without kanamycin) can be used to inoculate liquid cultures. For this, cells of a mutant or of the wild-type *Synechocystis* spec. PCC 6803 are transferred from plate into 10 ml of liquid culture in each case. These cultures are cultivated at 28° C. and 30 μmol photons*$(m^2 {*} s)^{-1}$ (30 μE) for about 3 days. After determination of the $OD_{730}$ of the individual cultures, the $OD_{730}$ of all cultures is synchronized by appropriate dilutions with BG-11 (wild types) or e.g. BG-11 km (mutants). These cell density-synchronized cultures are used to inoculate three cultures of the mutant and of the wild-type control. It is thus possible to carry out biochemical analyses using in each case three independently grown cultures of a mutant and of the corresponding wild types. The cultures are grown until the optical density was $OD_{730}=0.3$.

The cell culture medium is removed by centrifugation in an Eppendorf bench centrifuge at 14000 rpm twice. The subsequent disruption of the cells and extraction of sterols takes place by incubation in an Eppendorf shaker at 30° C., 1000 rpm in 100% methanol for 15 minutes twice, combining the supernatants obtained in each case.

In order to avoid oxidation, the resulting extracts can be analyzed immediate after the extraction with the aid of a Waters Alliance 2690 HPLC system. Sterols can be separated on a reverse phase column and identified by means of a standard. The fluorescence of the substances which can be detected with the aid of a Jasco FP 920 fluorescence detector, can serve as detection system.

for the disclosure of the paragraphs [0428.0.0.12] to [0435.0.0.12] see paragraphs [0428.0.0.0] to [0435.0.0.0] above.

Sterol Production

Sterols can be detected via HPLC, e.g. reversed-phase HPLC, as described by Heftmann, E. and Hunter, I. R. (J Chromatogr 1979; 165: 283-299). As separating principles of HPLC and GC are complementary, preparative reversed-phase HPLC followed by GC-MS analysis of the obtained sterol fractions is a preferred method to analyze sterols from natural products (Bianchini, J.-P. et al.; J Chromatogr 1985; 329: 231-246).

for the disclosure of the paragraphs [0437.0.0.12] and [0438.0.0.12] see paragraphs [0437.0.0.0] and [0438.0.0.0] above.

Example 8

Analysis of the Effect of the Nucleic Acid Molecule on the Production of the Respective Fine Chemical Indicated in Table I, Application No. 13, Column 6

The effect of the genetic modification in plants, fungi, algae or ciliates on the production of a desired compound such as sterols can be determined by growing the modified microorganisms or the modified plant under suitable conditions (such as those described above) and analyzing the medium and/or the cellular components for the elevated production of desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p.1-27, VCH: Weinheim; and Dechow, F. J. (1989) Separation and purification techniques in biotechnology, Noyes Publications).

Sterols can be detected advantageously as described above. for the disclosure of this paragraph see [0441.0.0.0] above.

Example 9

Purification of the Sterols

One example is the analysis of phytosterol: the content of the phytosterols of the invention can be determined by gas chromatography with flame ionisation detection (GC-FID; column SAC-5, 30 m×0.25 mm, 0.25 µm, samples not silylated) using standards for these phytosterols. Another method is the detection by gas chromatography-mass spectrometry (GC-MS) using the same type of column as indicated above.

For the analysis of the concentrations of sterols by gas chromatography mass spectrometry a Hewlett-Packard (HP) 5890 gas chromatograph equipped with an NB-54 fused-silica capillary column (15 m×0.20 mm I.D.; Nordion, Helsinki, Finland) and interfaced with an HP 5970A mass spectrometry detector operating in electron impact mode (70 eV) can be used. The column oven is programmed from 230° C. to 285° C. at 10° C./min and injector and detector should be at 285° C. The lipids from the samples (200 µl) are extracted with chloroform/methanol (2:1) and transesterified with sodium methoxide. The released free sterols are trimethylsilylated as described previously (Gylling et al. J. Lipid Res 40: 593-600, 1999) and quantified by single ion monitoring technique using m/z 129 (cholesterol, campesterol and β-sitosterol), m/z 215 (β-sitostanol), m/z 343 (desmosterol), m/z 255 (lathosterol) and m/z 217 (5-α-cholestane, internal standard) as selected ions (Vaskonen, Dissertation, Biomedicum Helsinki, Jun. 19, 2002).

Abbreviations: GC-MS, gas liquid chromatography/mass spectrometry; TLC, thin-layer chromatography.

The unambiguous detection for the presence of sterols can be obtained by analyzing recombinant organisms using analytical standard methods: GC, GC-MS or TLC, as described (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353).

The total sterols produced in the organism used in the inventive process can be analysed for example according to the following procedure:

The material such as yeasts, E. coli or plants to be analyzed can be disrupted by sonication, grinding in a glass mill, liquid nitrogen and grinding or via other applicable methods. Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, separation of non-polar epiphase from more polar hypophasic derivatives and chromatography.

Characterization of the Transgenic Plants

In order to confirm that sterols biosynthesis in the transgenic plants is influenced by the expression of the polypeptides described herein, the sterols content in leaves, seeds and/or preferably flowers of the plants transformed with the described constructs (Arabidopsis.thaliana, Brassica napus and Nicotiana tabacum) is analyzed. For this purpose, the transgenic plants are grown in a greenhouse, and plants which express the gene coding for polypeptide of the invention or used in the method of the invention are identified at the Northern level. The sterols content in flowers, leaves or seeds of these plants is measured. In all, the sterols concentration is raised by comparison with untransformed plants.

If required and desired, further chromatography steps with a suitable resin may follow. Advantageously, the sterols can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

for the disclosure of the paragraphs [0446.0.0.12] to [0496.0.0.12] see paragraphs [0446.0.0.0] to [0496.0.0.0] above.

As an alternative, the sterols can be detected advantageously as described above.

The results of the different plant analyses can be seen from the table, which follows:

TABLE VI

| ORF | Metabolite | Method/Analytics | Min.-Value | Max.-Value |
| --- | --- | --- | --- | --- |
| b0931 | beta-Sitosterol | GC | 1.13 | 1.27 |
| b1410 | beta-Sitosterol | GC | 1.20 | 1.26 |
| b1410 | Campesterol | GC | 1.19 | 1.23 |
| b1556 | Campesterol | GC | 1.26 | 1.52 |
| b1704 | Stigmasterol | GC | 1.83 | 7.65 |
| b2022 | Campesterol | GC | 1.22 | 1.27 |
| b3708 | Campesterol | GC | 1.18 | 1.85 |
| YDR035W | beta-Sitosterol | GC | 1.15 | 1.22 |
| YDR035W | Campesterol | GC | 1.20 | 1.25 |
| YLR027C | Campesterol | GC | 1.22 | 3.85 |
| YLR027C | beta-Sitosterol | GC | 1.24 | 3.19 |
| YNL241C | Campesterol | GC | 1.21 | 1.31 | for the disclosure of the paragraphs [0499.0.0.12] and [0500.0.0.12] see paragraphs [0499.0.0.0] and [0500.0.0.0] above.

Example 15a

Engineering Ryegrass Plants by Over-expressing b0931 from *E. coli* or Homologs of b0931 from Other Organisms for the disclosure of the paragraphs [0502.0.0.12] to [0508.0.0.12] see paragraphs [0502.0.0.0] to [0508.0.0.0] above.

Example 15b

Engineering Soybean Plants by Over-Expressing b0931 from *E. coli* or Homologs of b0931 from Other Organisms for the disclosure of the paragraphs [0510.0.0.12] to [0513.0.0.12] see paragraphs [0510.0.0.0] to [0513.0.0.0] above.

Example 15c

Engineering Corn Plants by Over-Expressing b0931 from *E. coli* or Homologs of b0931 from Other Organisms for the disclosure of the paragraphs [0515.0.0.12] to [0540.0.0.12] see paragraphs [0515.0.0.0] to [0540.0.0.0] above.

Example 15d

Engineering Wheat Plants by Over-Expressing b0931 from *E. coli* or Homologs of b0931 from Other Organisms for the disclosure of the paragraphs [0542.0.0.12] to [0544.0.0.12] see paragraphs [0542.0.0.0] to [0544.0.0.0] above.

Example 15e

Engineering Rapeseed/Canola Plants by Over-Expressing b0931 from *E. coli* or Homologs of b0931 from Other Organisms for the disclosure of the paragraphs [0546.0.0.12] to [0549.0.0.12] see paragraphs [0544.0.0.0] to [0549.0.0.0] above.

Example 15f

Engineering Alfalfa Plants by Over-Expressing b0931 from *E. coli* or Homologs of b0931 from Other Organisms for the disclosure of the paragraphs [0551.0.0.12] to [0554.0.0.12] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII as minimal (MIN) or maximal changes (MAX) in the respective fine chemical (column "metabolite") in genetically modified corn plants expressing the sequence listed in column 1 (ORF):

TABLE VII

| ORF | Metabolite | MIN | MAX |
|---|---|---|---|
| YDR035W | Campesterol | 1.37 | 1.49 |
| YLR027C | beta-Sitosterol | 1.26 | 1.59 |

Table VII shows the increase in campesterol in genetically modified corn plants expressing the *Saccharomyces cerevisiae* nucleic acid sequence YDR035W.

In one embodiment, in case the activity of the *Saccharomyces cerevisiae* protein YDR035W or its homologs, e.g. a "3-deoxy-D-arabino-heptulosonate 7-phosphate (DAHP) synthase", is increased in corn plants, preferably, an increase of the fine chemical campesterol between 37% and 49% is conferred.

Furthermore table VII shows the increase in beta-sitosterol in genetically modified corn plants expressing the *Saccharomyces cerevisiae* nucleic acid sequence YLR027C.

In one embodiment, in case the activity of the *Saccharomyces cerevisiae* protein YLR027C or its homologs, e.g. a "aspartate aminotransferase", is increased in corn plants, preferably, an increase of the fine chemical campesterol between 26% and 59% is conferred.

for the disclosure of this paragraph see [0554.2.0.0] above.
for the disclosure of this paragraph see [0555.0.0.0] above.
for the disclosure of this paragraph see [0001.0.0.0].
for the disclosure of this paragraph see paragraph [0002.0.0.0] above.

L-alanine is used in various pharmaceutical and veterinary applications. For example, it is included, together with other amino acids, in preparations for infusion solutions or preparations for parenteral administration as clinical preoperative and postoperative foods, as well as an animal feed supplement. Furthermore, alanine is used as a food additive on account of its sweet taste. L-phenylalanine and L-aspartic acid have very important markets as key components in the manufacture of the sweetener aspartame. Aspartame ($C_{14}H_{18}N_2O_5$), L-aspartyl-L-phenylalanine methyl ester, is a compound of three components, which are methanol, aspartic acid and phenylalanine. L-aspartic acid is further used as a flavoring agent.

The amino acid L-citrulline is a metabolite in the urea cycle. Other amino acids in this cycle are L-arginine and L-ornithine. L-citrulline is involved in liver detoxification of ammonia, and has been shown to speed recover from fatigue. It has also been utilized in the treatment of Ornithine Transcarbamylase Deficiency and other Urea Cycle disorders. In cell metabolism, L-arginine and L-citrulline might serve as endogenous N sources (Ludwig et al., PLANT PHYSIOLOGY, Vol 101, Issue 2 429-434, 1993). Glycine is a valuable compound of wide use as food additives for processed foodstuffs and raw materials for agricultural chemicals and medicines. Glycine is the simplest amino acid, and is used in crop production as a chelating agent for micronutrients and has been used as a nitrogen fertilizer, at least on an experimental basis. As such, it is representative of amino acids used in crop production. Practically all commercial glycine is produced by synthetic processes such as the Strecker Synthesis, the reaction of formaldehyde, ammonia, and hydrogen cyanide, and hydrolysis of the resulting aminonitrile. Glycine is used as chelating/complexing agent for cation nutrients, plant growth regulators, substrate for microbiological products, fertilizer source of nitrogen.

Serine is a primary intermediate in the biosynthesis of a wide variety of cellular metabolites including such economically important compounds as choline, glycine, cysteine and tryptophan. In addition, serine acts as a single carbon donor and is responsible for 60% to 75% of the total need of the cell for C1 units through the production of 5,10-methylenetetrahydrofolate from tetrahydrofolate. These C1 units are used in a wide variety of biosynthetic pathways including the synthesis of methionine, inosine monophosphate, other purines and some pyrimidines (e.g., thymidine and hydroxymethyl cytidine).

The glycine-serine interconversion, catalysed by glycine decarboxylase and serine hydroxymethyltransferase, is an important reaction of primary metabolism in all organisms including plants, by providing one-carbon units for many biosynthetic reactions. In plants, in addition, it is an integral part of the photorespiratory metabolic pathway and produces large amounts of photorespiratory $CO_2$ within mitochondria (Bauwe et al., Journal of Experimental Botany, Vol. 54, No. 387, pp. 1523-1535, Jun. 1, 2003.)

The enzymatic conversion of phenylalanine to tyrosine is known in eukaryotes. Human phenylalanine hydroxylase is specifically expressed in the liver to convert L-phenylalanine to L-tyrosine (Wang et al. J. Biol. Chem. 269 (12): 9137-46 (1994)). Deficiency of the PAH enzyme causes classic phenylketonurea, a common genetic disorder.

Tyrosine and homoserine and their derivatives are also used in organic synthesis. For example, tyrosine is starting material in the synthesis of chatecolamines or DOPA (dihydroxy-phenyl-alanine) as well as a precursor of adrenaline, dopamine and norepinepherine. A variety of beta-amino-gamma-keto acids can be prepared from commercially available I-homoserine.

5-Oxoproline, also named as pyroglutamic acid PCA and slats like sodium-PCA, is used as cosmetic ingredient, such as hair and skin conditioning agent. One optical isomer of PCA (the L form) is a naturally occurring component of mammalian tissue. 5-Oxoproline is further used as templates in the synthesis of homochiral glutamate antagonists.

for the disclosure of these paragraphs see paragraphs [0003.0.0.0] to [0008.0.0.0] above.

U.S. Pat. No. 5,498,532 disclose the production of various L-amino acids like glutamic acid, glutamine, lysine, threonine, isoleucine, valine, leucine, tryptophan, phenylalanine, tyrosine, histidine, arginine, ornithine, citrulline and proline by direct fermentation using, coryneform bacteria belonging to the genus *Corynbacterium* or *Brevibacterium*, which are inherently unable to assimilate lactose, but due to recombinant DNA technology able to assimilate lactose, which represent the carbon source.

An other method for producing amino acids such as homoserine is disclosed in US 20010049126, which use a bacterium belonging to the genus *Escherichia* which harbors a PTS, phosphotransferase system, gene.

The coproduction of glutamic acid and other amino acids including lysine, aspartic acid, alanine by an auxotroph of *Bacillus methanolicus* is described in U.S. Pat. No. 6,110,713. According to the teaching of U.S. Pat. No. 5,677,156 L-aspartic acid can be efficiently produced from maleic acid or fumaric acid by adding the aspartase-containing microorganism, like *Brevibacterium flavum* AB-41 strain (FERM BP-1498) and *Eschirichia coli* ATCC 11303.

U.S. Pat. No. 5,354,672 discloses a method of producing tyrosine, methionine, or phenylalanine by transiently incorporating a DNA inversion gene into the host cell, *Escherichia coli* cells, which induce hypersecretion of amino acids.

Known is also the production of citrulline in the small intestine as a product of glutamine metabolism, or in the arginine biosynthetic pathway, where ornithine carbamoyl-transferases catalyse the production of citrulline from carbamoyl-phosphate and ornithine. Benninghoff et al. disclose the production of citrulline and ornithine by interferon-gamma treated macrophages (International Immunology, Vol 3, 413-417, 1991).

There disclosed is a method for producing glycine in US 20030040085, which comprises subjecting an aqueous solution of glycinonitrile to a hydrolysis reaction in a hydrolysis reaction system under the action of a microbial enzyme, thereby converting the glycinonitrile to glycine while by-producing ammonia.

US 20040157290 discloses a process for preparing a serine-rich foreign protein comprising culturing a bacterium containing the cysteine synthase (cysk) gene and a gene encoding the foreign protein.

US 20030079255 disclose the production of Para-hydroxycinnamic acid by introducing genes encoding phenylalanine ammonia-lyase from C. violaceum or R. glutinis tyrosine into a host microorganism and as intermediates, tyrosine and cinnamic acid are also produced.

Production of single cell protein and selected amino acids by microbial fermentation is known, e.g., U.S. Pat. No. 4,652,527. One amino acid which has been produced on an industrial scale is lysine, see Tosaka et al., Trends in Biotechnology, 1: 70-74 (1983), Tosaka and Takinami, Progress in Industrial Microbiology, Ch. 24, pp. 152-172 (Aida et al., 1986). Another example is glutamic acid which has been produced using bacteria of the genera *Corynebacterium, Brevibacterium, Microbacterium*, and *Arothrobacter* by fermentation on molasses and starch hydrozylates. Aspartic acid and alanine are produced by enzymatic means from fumaric acid and ammonia. *Bacillus* species have been used in fermentation processes to produce amino acids, Tosaka et al.; Tosaka and Takinami, as named above.

for the disclosure of these paragraphs see paragraphs [0010.0.0.0] to [0011.0.0.0] above.

It is an object of the present invention to develop an inexpensive process for the synthesis of amino acids, preferably 5-oxoproline, alanine, aspartic acid, citrulline, glycine, homoserine, phenylalanine, serine and/or tyrosine. Amino acids are (depending on the organism) one of the most frequently limiting components of food or feed.

for the disclosure of this paragraphs see paragraphs [0013.0.0.0] above.

Accordingly, in a first embodiment, in context of paragraphs [0001.n.n.13] to [0555.n.n.13] the invention relates to a process for the production of a fine chemical, whereby the fine chemical are amino acids of the invention, e.g. "5-oxoproline", "alanine", "aspartic acid", "citrulline", "glycine", "homoserine", "phenylalanine", "serine" and/or "tyrosine". Accordingly, in the present invention, the term "the fine chemical" as used herein relates to "amino acids of the invention". Further, the term "the fine chemicals" as used herein also relates to fine chemicals comprising amino acids of the invention.

In one embodiment, the term "the fine chemical" or "the respective fine chemical" or "amino acids of the invention" means at least one chemical compound with amino acid activity selected from the group of 5-oxoproline, alanine, aspartic acid, citrulline, glycine, homoserine, phenylalanine, serine and/or tyrosine.

In one embodiment, the term "the fine chemical" or "the respective fine chemical" or "or "amino acids of the invention"" or "one chemical compound with amino acid activity" means an organic amphoteric chemical compound comprising an amnino group (NH2) and a carboxylic group (COOH) bound to the same or different carbon atoms of a hydrocarbonic backbone whereof optionally further functional groups, e.g. amnino group (NH2), carboxylic group (COOH), carbonyl group (CO), hydroxy (OH) or mercapto group (SH) or aryls like phenyl.

In an preferred embodiment, the term "the fine chemical" or the term "amino acid" or "or "amino acids of the invention" the term "the respective fine chemical" means at least one chemical compound with amnio acid activity selected from the group "5-oxoproline", "alanine", "aspartic acid", "citrulline", "glycine", "homoserine", "phenylalanine", "serine" and/or "tyrosine.

An increased content normally means an increased total amino acid content. However, an increased amino acid content also means, in particular, a modified content of the above-described 9 compounds with amino acid activity, without the need for an inevitable increase in the total amino acid content. In a preferred embodiment, the term "the fine chemical" means amino acid in free form or its salts or its ester or bound.

Accordingly, the present invention relates to a process for the production of amino acids of the invention which comprises
(a) increasing or generating the activity of a protein as shown in table II, application no. 14, column 3 encoded by the nucleic acid sequences as shown in table I, application no. 14, column 5, in an organelle of a microorganism or plant, or
(b) increasing or generating the activity of a protein as shown in table II, application no. 14, column 3 encoded by the nucleic acid sequences as shown in table I, application no. 14, column 5 in the plastid of a microorganism or plant, or in one or more parts thereof; and
(c) growing the organism under conditions which permit the production of the fine chemical, thus amino acids of the invention or fine chemicals comprising amino acids of the invention, in said organism or in the culture medium surrounding the organism.

Accordingly, the term "the fine chemical" means in one embodiment "amino acids of the invention" in relation to all sequences listed in Table I to IV, application no. 15.

Accordingly, the term "the fine chemical" means in one embodiment "5-oxoproline" in relation to all sequences listed in Table I to IV, line 115 or homologs thereof and means in one embodiment "alanine" in relation to all sequences listed in Tables I to IV, lines 116 to 122 or homologs thereof and means in one embodiment "aspartic acid" respectively "aspartate" in relation to all sequences listed in Table I, lines 123 to 128, and
means in one embodiment "citrulline" in relation to all sequences listed in Table I to IV, lines 129 to 137 and
means in one embodiment "glycine" in relation to all sequences listed in Table I to IV, lines 138 to 142 and
means in one embodiment "homoserine" in relation to all sequences listed in Table I to IV, lines 143 to 147 and
means in one embodiment "phenylalanine" in relation to all sequences listed in Table I to IV, lines 148 to 160 and
means in one embodiment "serine" in relation to all sequences listed in Table I to IV, lines 161 to 169 and
means in one embodiment "tyrosine" in relation to all sequences listed in Table I to IV, lines 170 to 180.

Accordingly, in one embodiment the term "the fine chemical" means any combination of 2, 3, 4 or all 5 of the fine chemicals, e.g. compounds, selected from the group of "alanine", "citrulline", "glycine", "homoserine" and "serine". in relation to all sequences listed in Table I to IV, lines 117, 129, 138, 144 and/or 161;

in one embodiment the term "the fine chemical" means "citrulline" and "phenylalanine" in relation to all sequences listed in Table I to IV, lines 130 and/or 150;

in one embodiment the term "the fine chemical" means "phenylalanine" and "glycine" in relation to all sequences listed in Table I to IV, lines 151 and/or 139;

in one embodiment the term "the fine chemical" means any combination of 2, 3, 4 or all 5 of the fine chemicals, e.g. compounds, selected from the group of "alanine", "citrulline", "glycine", "homoserine" and "serine" in relation to all sequences listed in Table I to IV, lines 118, 131, 140, 145 and/or 162;

in one embodiment the term "the fine chemical" means "5-oxoproline" and "aspartate" in relation to all sequences listed in Table I to IV, lines 115 and/or 124;

in one embodiment the term "the fine chemical" means "phenylalanine" and "tyrosine" in relation to all sequences listed in Table I to IV, lines 152 and/or 171;

in one embodiment the term "the fine chemical" means any combination of 2 or all 3 of the fine chemicals, e.g. compounds, selected from the group of "citrulline", "serine" and "aspartate" in relation to all sequences listed in Table I to IV, lines 132, 164 and/or 125;

in one embodiment the term "the fine chemical" means "citrulline" and "glycine" in relation to all sequences listed in Table I to IV, lines 133 and/or 141;

in one embodiment the term "the fine chemical" means "phenylalanine" and "tyrosine" in relation to all sequences listed in Table I to IV, lines 153 and/or 174;

in one embodiment the term "the fine chemical" means any combination of 2, 3 or all 4 of the fine chemicals, e.g. compounds, selected from the group of "phenylalanine", "alanine", "glycine" and "serine" in relation to all sequences listed in Table I to IV, lines 154, 119, 142 and/or 165;

in one embodiment the term "the fine chemical" means "phenylalanine" and "tyrosine" in relation to all sequences listed in Table I to IV, lines 155 and/or 175;

in one embodiment the term "the fine chemical" means "serine" and "homoserine" in relation to all sequences listed in Table I to IV, lines 167 and/or 146;

in one embodiment the term "the fine chemical" means "citrulline" and "serine" in relation to all sequences listed in Table I to IV, lines 137 and/or 168;

in one embodiment the term "the fine chemical" means "alanine" and "phenylalanine" in relation to all sequences listed in Table I to IV, lines 121 and/or 156;

in one embodiment the term "the fine chemical" means "tyrosine" and "phenylalanine" in relation to all sequences listed in Table I to IV, lines 177 and/or 157;

in one embodiment the term "the fine chemical" means "serine" and "phenylalanine" in relation to all sequences listed in Table I to IV, lines 169 and/or 159;

in one embodiment the term "the fine chemical" means "alanine" and "tyrosine" in relation to all sequences listed in Table I to IV, lines 122 and/or 180.

Accordingly, the term "the fine chemical" can mean "5-oxoproline", "alanine", "aspartic acid", "citrulline", "glycine", "homoserine", "phenylalanine", "serine" and/or "tyrosine", owing to circumstances and the context. In order to illustrate that the meaning of the term "the fine chemical" means "5-oxoproline", "alanine", "aspartic acid", "citrulline", "glycine", "homoserine", "phenylalanine", "serine" and/or "tyrosine" the term "the respective fine chemical" is also used.

In another embodiment the present invention is related to a process for the production of amino acids of the invention, which comprises
(a) increasing or generating the activity of a protein as shown in table II, application no. 14 column 3 encoded by the nucleic acid sequences as shown in table I, application no. 14, column 5, in an organelle of a non-human organism, or
(b) increasing or generating the activity of a protein as shown in table II, application no. 14, column 3 encoded by the nucleic acid sequences as shown in table I, application no. 14, column 5, which are joined to a nucleic acid sequence encoding a transit peptide in a non-human organism, or in one or more parts thereof; or
(c) increasing or generating the activity of a protein as shown in table II, application no. 14, column 3 encoded by the nucleic acid sequences as shown in table I, application no. 14, column 5, which are joined to a nucleic acid sequence encoding chloroplast localization sequence, in a non-human organism, or in one or more parts thereof, and
(d) growing the organism under conditions which permit the production of amino acids in said organism.

In another embodiment, the present invention relates to a process for the production of amino acids of the invention, which comprises
(a) increasing or generating the activity of a protein as shown in table II, application no. 14, column 3 encoded by the nucleic acid sequences as shown in table I, application no. 14, column 5, in an organelle of a microorganism or plant through the transformation of the organelle, or
(b) increasing or generating the activity of a protein as shown in table II, application no. 14, column 3 encoded by the nucleic acid sequences as shown in table I, application no. 14, column 5 in the plastid of a microorganism or plant, or in one or more parts thereof through the transformation of the plastids; and
(c) growing the organism under conditions which permit the production of the fine chemical, thus, amino acids of the invention or fine chemicals comprising amino acids of the invention, in said organism or in the culture medium surrounding the organism.

Advantageously the activity of the protein as shown in table II, application no. 14, column 3 encoded by the nucleic acid sequences as shown in table I, application no. 14, column 5 is increased or generated in the abovementioned process in the plastid of a microorganism or plant.

for the disclosure of the paragraphs [0019.0.0.13] to [0024.0.0.13] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 14, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 14, column 3 and its homologs as disclosed in table I, application no. 14, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 14, column 3 and its homologs as disclosed in table I, application no. 14, columns 5 and 7.

for the disclosure of the paragraphs [0027.0.0.13] to [0029.0.0.13] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 13, columns 5 and 7. The person skilled in the art is able to join said sequences in a functional manner. Advantageously the transit peptide part is cleaved off from the protein part shown in table II, application no. 14, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 14, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 14, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 14, columns 5 and 7. Furthermore the skilled worker is aware of the fact that there is not a need for such short sequences in the expression of the genes.

Table V: Examples of transit peptides disclosed by von Heijne et al.: for the disclosure of the Table V see Table V above, paragraphs [0030.0.0.0] above.

Alternatively to the targeting of the sequences shown in table II, application no. 14, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 14, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.13] and [0030.3.0.13] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 14, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 14, columns 5 and 7 or a sequence encoding a protein, as depicted in table II, application no. 14, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table, 1, application no. 14, columns 5 and 7 or a sequence encoding a protein, as depicted in table II, application no. 14, columns 5 and 7 in such a manner that the viroid sequence transports a sequence transcribed from a sequence as depicted in table 1 application no. 14, columns 5 and 7 or a sequence encoding a protein as depicted in table II, application no. 14, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 14, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 14, columns 5 and 7.

In a preferred embodiment of the invention the nucleic acid sequences as shown in table I, application no. 14, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 14, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.13] and [0032.0.0.13] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 14, column 3. Preferably the modification of the activity of a protein as shown in table II, application no. 14, column 3 or their combination can be achieved by joining the protein to a transit peptide.

Surprisingly it was found, that the transgenic expression of the *E. coli* proteins and/or *Saccharomyces cerevisiae* proteins shown in table II, application no. 14, column 3 in plastids of a plant such as *Arabidopsis thaliana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *E. coli* protein b1640 in combination with a plastidal targeting sequence in *Arabidopsis thaliana* conferred an increase in 5-oxoproline.

Surprisingly it was found, that the transgenic expression of the *E. coli* protein b0342, b1062, b1264, b2965 and/or b4053 and/or the *Saccharomyces cerevisiae* protein YAL038W and/or YNL241C in combination with a plastidal targeting sequence in *Arabidopsis thaliana* conferred an increase in alanine.

Surprisingly it was found, that the transgenic expression of the *E. coli* protein b1556, b1640, b1758, b2066 and/or b2312, and/or the *Saccharomyces cerevisiae* protein YNR012W in combination with a plastidal targeting sequence in *Arabidopsis thaliana* conferred an increase in aspartate.

Surprisingly it was found, that the transgenic expression of the *E. coli* protein b1062, b1136, b1264, b1758, b2366, b2818, b3117, b3213 and/or b4139 in combination with a plastidal targeting sequence in *Arabidopsis thaliana* conferred an increase in citrulline.

Surprisingly it was found, that the transgenic expression of the *E. coli* protein b1062, b1223, b1264, b2366 and/or b2965 in combination with a plastidal targeting sequence in *Arabidopsis thaliana* conferred an increase in glycine.

Surprisingly it was found, that the transgenic expression of the *E. coli* protein b0628, b1062, b1264 and/or b3616, and/or the *Saccharomyces cerevisiae* protein YEL046C in combination with a plastidal targeting sequence in *Arabidopsis thaliana* conferred an increase in homoserine.

Surprisingly it was found, that the transgenic expression of the *E. coli* protein b0403, b0754, b1136, b1223, b1704, b2601, b2965 and/or b3390, and/or the *Saccharomyces cerevisiae* protein YAL038W, YDR035W, YDR430C, YKR043C and/or YOR353C in combination with a plastidal targeting sequence in *Arabidopsis thaliana* conferred an increase in phenylalanine.

Surprisingly it was found, that the transgenic expression of the *E. coli* protein b1062, b1264, b1611, b1758, b2965, b3429, b3616 and/or b4139, and/or the *Saccharomyces cerevisiae* protein YKR043C in combination with a plastidal targeting sequence in *Arabidopsis thaliana* conferred an increase in serine.

Surprisingly it was found, that the transgenic expression of the *E. coli* protein b0760, b1704, b2223, b2600, b2601 and/or b3390, and/or the *Saccharomyces cerevisiae* protein YBL082C, YDR035W, YDR497C, YLR174W, YNL241C in combination with a plastidal targeting sequence in *Arabidopsis thaliana* conferred an increase in tyrosine.

for the disclosure of this paragraph see paragraph [0035.0.0.0] above.

The sequence of b0342 (Accession number PIR:XX-ECTG) from *Escherichia coli* has been published in Blattner et al., Science 277 (5331), 1453-1474 (1997), and its activity is being defined as "thiogalactoside acetyltransferase". Accordingly, in one embodiment, the process of the present invention comprises the use of a "thiogalactoside acetyltransferase" or its homolog, e.g. as shown herein, for the production of the fine chemical, meaning of amino acids of the invention, in particular for increasing the amount of alanine in free or bound form in an organism or a part thereof, as mentioned. In one embodiment, in the process of the present invention the activity of a b0342 protein is increased or generated, e.g. from *Escherichia coli* or a homolog thereof, preferably linked at least to one transit peptide as mentioned for example in table V.

In another embodiment, in the process of the present invention the activity of a b0342 protein is increased or generated in a subcellular compartment of the organism or organism cell such as in an organelle like a plastid or mitochondria.

The sequence of b0403 (Accession number PIR:C64769) from *Escherichia coli* has been published in Blattner et al., Science 277 (5331), 1453-1474 (1997), and its activity is being defined as "maltodextrin glucosidase". Accordingly, in one embodiment, the process of the present invention comprises the use of a "maltodextrin glucosidase" or its homolog, e.g. as shown herein, for the production of the fine chemical, meaning of amino acids of the invention, in particular for increasing the amount of phenylalanine in free or bound form in an organism or a part thereof, as mentioned. In one embodiment, in the process of the present invention the activity of a b0403 protein is increased or generated, e.g. from *Escherichia coli* or a homolog thereof, preferably linked at least to one transit peptide as mentioned for example in table V.

In another embodiment, in the process of the present invention the activity of a b0403 protein is increased or generated in a subcellular compartment of the organism or organism cell such as in an organelle like a plastid or mitochondria.

The sequence of b0628 from *Escherichia coli* (Accession NP_415161) has been published in Blattner et al., Science 277 (5331), 1453-1474 (1997), and its activity is being defined as "lipoate synthase" or "an iron-sulfur enzyme". Accordingly, in one embodiment, the process of the present invention comprises the use of a "lipoate synthase" or "an iron-sulfur enzyme" or its homolog, e.g. as shown herein, for the production of the fine chemical, meaning of amino acids of the invention, in particular for increasing the amount of homoserine in free or bound form in an organism or a part thereof, as mentioned. In one embodiment, in the process of the present invention the activity of a b0628 protein is increased or generated, e.g. from *Escherichia coli* or a homolog thereof, preferably linked at least to one transit peptide as mentioned for example in table V.

In another embodiment, in the process of the present invention the activity of a b0628 protein is increased or generated in a subcellular compartment of the organism or organism cell such as in an organelle like a plastid or mitochondria.

The sequence of b0754 from *Escherichia coli* (Accession PIR:ADECHF) has been published in Blattner et al., Science 277 (5331), 1453-1474 (1997), and its activity is being defined as "3-deoxy-D-arabinoheptulosonate-7-phosphate synthase (DAHP synthetase, phenylalanine-repressible)". Accordingly, in one embodiment, the process of the present invention comprises the use of a "3-deoxy-D-arabinoheptulosonate-7-phosphate synthase (DAHP synthetase, phenylalanine-repressible)" or its homolog, e.g. as shown herein, for the production of the fine chemical, meaning of amino acids of the invention, in particular for increasing the amount phenylalanine in free or bound form in an organism or a part thereof, as mentioned. In one embodiment, in the process of the present invention the activity of a b0754 protein is increased or generated, e.g. from *Escherichia coli* or a homolog thereof, preferably linked at least to one transit peptide as mentioned for example in table V.

In another embodiment, in the process of the present invention the activity of a b0754 protein is increased or generated in a subcellular compartment of the organism or organism cell such as in an organelle like a plastid or mitochondria.

The sequence of b0760 from *Escherichia coli* (Acession PIR:JC6038) has been published in Blattner et al., Science 277 (5331), 1453-1474 (1997), and its activity is being defined as "ATP-binding component of molybdate transport system". Accordingly, in one embodiment, the process of the present invention comprises the use of a "ATP-binding component of molybdate transport system" or its homolog, e.g. as shown herein, for the production of the fine chemical, meaning of amino acids of the invention, in particular for increasing the amount of tyrosine in free or bound form in an organism or a part thereof, as mentioned. In one embodiment, in the process of the present invention the activity of a b0760 protein is increased or generated, e.g. from *Escherichia coli* or a homolog thereof, preferably linked at least to one transit peptide as mentioned for example in table V.

In another embodiment, in the process of the present invention the activity of a b0760 protein is increased or generated in a subcellular compartment of the organism or organism cell such as in an organelle like a plastid or mitochondria.

The sequence of b1062 from *Escherichia coli* (Acession PIR:DEECOO) has been published in Blattner et al., Science 277 (5331), 1453-1474 (1997), and its activity is being defined as "dihydro-orotase". Accordingly, in one embodiment, the process of the present invention comprises the use of a "dihydro-orotase" or its homolog, e.g. as shown herein, for the production of the fine chemical, meaning of amino acids of the invention, in particular for increasing the amount of one or of any combination of 2, 3, 4 or all 5 of the fine chemicals, e.g. compounds, selected from the group of "alanine", "citrulline", "glycine", "homoserine" and "serine" in free or bound form in an organism or a part thereof, as mentioned. In one embodiment, in the process of the present invention the activity of a b1062 protein is increased or generated, e.g. from *Escherichia coli* or a homolog thereof, preferably linked at least to one transit peptide as mentioned for example in table V.

In another embodiment, in the process of the present invention the activity of a b1062 protein is increased or generated in a subcellular compartment of the organism or organism cell such as in an organelle like a plastid or mitochondria.

The sequence of b1136 from *Escherichia coli* (Acession PIR:DCECIS) has been published in Blattner et al., Science 277 (5331), 1453-1474 (1997), and its activity is being defined as "isocitrate dehydrogenase (NADP)". Accordingly, in one embodiment, the process of the present invention comprises the use of a "isocitrate dehydrogenase (NADP)" or its homolog, e.g. as shown herein, for the production of the fine chemical, meaning of amino acids of the invention, in particular for increasing the amount of citrulline and/or phenylalanine in free or bound form in an organism or a part thereof, as mentioned. In one embodiment, in the process of the present invention the activity of a b1136 protein is increased or generated, e.g. from *Escherichia coli* or a homolog thereof, preferably linked at least to one transit peptide as mentioned for example in table V.

In another embodiment, in the process of the present invention the activity of a b1136 protein is increased or generated in a subcellular compartment of the organism or organism cell such as in an organelle like a plastid or mitochondria.

The sequence of b1223 from *Escherichia coli* (Accession NP_415741) has been published in Blattner et al., Science 277 (5331), 1453-1474 (1997), and its activity is being defined as "nitrite extrusion protein". Accordingly, in one embodiment, the process of the present invention comprises the use of a "nitrite extrusion protein" or its homolog, e.g. as shown herein, for the production of the fine chemical, meaning of amino acids of the invention, in particular for increasing the amount of glycine and/or phenylalanine in free or bound form in an organism or a part thereof, as mentioned. In one embodiment, in the process of the present invention the activity of a b1223 protein is increased or generated, e.g. from *Escherichia coli* or a homolog thereof, preferably linked at least to one transit peptide as mentioned for example in table V.

In another embodiment, in the process of the present invention the activity of a b1223 protein is increased or generated in a subcellular compartment of the organism or organism cell such as in an organelle like a plastid or mitochondria.

The sequence of b1264 from *Escherichia coli* (Accession NP_415780) has been published in Blattner et al., Science 277 (5331), 1453-1474 (1997), and its activity is being defined as "anthranilate synthase". Accordingly, in one embodiment, the process of the present invention comprises the use of a "anthranilate synthase" or its homolog, e.g. as shown herein, for the production of the fine chemical, meaning of amino acids of the invention, in particular for increasing the amount of one or of any combination of 2, 3, 4 or all 5 of the fine chemicals, e.g. compounds, selected from the group of "alanine", "citrulline", "glycine", "homoserine" and "serine" in free or bound form in an organism or a part thereof, as mentioned. In one embodiment, in the process of the present invention the activity of a b1264 protein is increased or generated, e.g. from *Escherichia coli* or a homolog thereof, preferably linked at least to one transit peptide as mentioned for example in table V.

In another embodiment, in the process of the present invention the activity of a b1264 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of amino acids of the invention, in particular for increasing the amount of aspartate in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1611 (Accession number NP_416128) from *Escherichia coli* has been published in Blattner et al., Science 277 (5331), 1453-1474 (1997), and its activity is being defined as "fumarase C (fumarate hydratase Class II)". Accordingly, in one embodiment, the process of the present invention comprises the use of a "fumarase C (fumarate hydratase Class II)" or its homolog, e.g. as shown herein, for the production of the fine chemical, meaning of amino acids of the invention, in particular for increasing the amount of serine in free or bound form in an organism or a part thereof, as mentioned. In one embodiment, in the process of the present invention the activity of a b1611 protein is increased or generated, e.g. from *Escherichia coli* or a homolog thereof, preferably linked at least to one transit peptide as mentioned for example in table V.

In another embodiment, in the process of the present invention the activity of a b1611 protein is increased or generated in a subcellular compartment of the organism or organism cell such as in an organelle like a plastid or mitochondria.

The sequence of b1640 (Accession number NP_416157) from *Escherichia coli* has been published in Blattner et al., Science 277 (5331), 1453-1474 (1997), and its activity is being defined as "conserved hypothetical protein with actin-like ATPase domain". Accordingly, in one embodiment, the process of the present invention comprises the use of a "conserved hypothetical protein with actin-like ATPase domain" or its homolog, e.g. as shown herein, for the production of the fine chemical, meaning of amino acids of the invention, in particular for increasing the amount of 5-oxoproline and/or aspartate in free or bound form in an organism or a part thereof, as mentioned. In one embodiment, in the process of the present invention the activity of a b1640 protein is increased or generated, e.g. from *Escherichia coli* or a homolog thereof, preferably linked at least to one transit peptide as mentioned for example in table V.

In another embodiment, in the process of the present invention the activity of a b1640 protein is increased or generated in a subcellular compartment of the organism or organism cell such as in an organelle like a plastid or mitochondria.

The sequence of b1704 from *Escherichia coli* (Accession NP_416219) has been published in Blattner et al., Science 277 (5331), 1453-1474 (1997), and its activity is being defined as "3-deoxy-D-arabinoheptulosonate-7-phosphate synthase (DAHP synthetase), tryptophan-repressible". Accordingly, in one embodiment, the process of the present invention comprises the use of a "3-deoxy-D-arabinoheptulosonate-7-phosphate synthase (DAHP synthetase), tryptophan-repressible" or its homolog, e.g. as shown herein, for the production of the fine chemical, meaning of amino acids of the invention, in particular for increasing the amount of phenylalanine and/or tyrosine in free or bound form in an organism or a part thereof, as mentioned. In one embodiment, in the process of the present invention the activity of a b1704 protein is increased or generated, e.g. from *Escherichia coli* or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b1758 from *Escherichia coli* (Accession NP_416272) has been published in Blattner et al., Science 277 (5331), 1453-1474 (1997), and its activity is being defined as "cytochrome oxidase". Accordingly, in one embodiment, the process of the present invention comprises the use of a "cytochrome oxidase" or its homolog, e.g. as shown herein, for the production of the fine chemical, meaning of amino acids of the invention, in particular for increasing the amount of one or any combination of 2 or all 3 of the fine chemicals, e.g. compounds, selected from the group of "citrulline", "aspartate", and "serine" in free or bound form in an organism or a part thereof, as mentioned. In one embodiment, in the process of the present invention the activity of a b1758 protein is increased or generated, e.g. from *Escherichia coli* or a homolog thereof, preferably linked at least to one transit peptide as mentioned for example in table V. In another embodiment, in the process of the present invention the activity of a b1758 protein is increased or generated in a subcellular compartment of the organism or organism cell such as in an organelle like a plastid or mitochondria.

The sequence of b2066 (Accession number NP_416570) from *Escherichia coli* has been published in Blattner et al., Science 277 (5331), 1453-1474 (1997), and its activity is being defined as "uridine/cytidine kinase". Accordingly, in one embodiment, the process of the present invention comprises the use of a "uridine/cytidine kinase" or its homolog, e.g. as shown herein, for the production of the fine chemical, meaning of amino acids of the invention, in particular for increasing the amount of aspartate in free or bound form in an organism or a part thereof, as mentioned. In one embodiment, in the process of the present invention the activity of a b2066 protein is increased or generated, e.g. from *Escherichia coli* or a homolog thereof, preferably linked at least to one transit peptide as mentioned for example in table V.

In another embodiment, in the process of the present invention the activity of a b2066 protein is increased or generated in a subcellular compartment of the organism or organism cell such as in an organelle like a plastid or mitochondria.

The sequence of b2223 (Accession number NP_416727) from *Escherichia coli* has been published in Blattner et al., Science 277 (5331), 1453-1474 (1997), and its activity is being defined as "short chain fatty acid transporter". Accordingly, in one embodiment, the process of the present invention comprises the use of a "short chain fatty acid transporter" or its homolog, e.g. as shown herein, for the production of the fine chemical, meaning of amino acids of the invention, in particular for increasing the amount of tyrosine in free or bound form in an organism or a part thereof, as mentioned. In one embodiment, in the process of the present invention the activity of a b2223 protein is increased or generated, e.g. from *Escherichia coli* or a homolog thereof, preferably linked at least to one transit peptide as mentioned for example in table V.

In another embodiment, in the process of the present invention the activity of a b2223 protein is increased or generated in a subcellular compartment of the organism or organism cell such as in an organelle like a plastid or mitochondria.

The sequence of b2312 from *Escherichia coli* (Accession PIR:XQEC) has been published in Blattner et al., Science 277 (5331), 1453-1474 (1997), and its activity is being defined as "amidophosphoribosyltransferase (PRPP amido transferase)". Accordingly, in one embodiment, the process of the present invention comprises the use of a "amidophosphoribosyltransferase (PRPP amidotransferase)" or its homolog, e.g. as shown herein, for the production of the fine chemical, meaning of amino acids of the invention, in particular for increasing the amount of aspartate in free or bound form in an organism or a part thereof, as mentioned. In one embodiment, in the process of the present invention the activity of a b2312 protein is increased or generated, e.g. from *Escherichia coli* or a homolog thereof, preferably linked at least to one transit peptide as mentioned for example in table V.

In another embodiment, in the process of the present invention the activity of a b23122 protein is increased or generated in a subcellular compartment of the organism or organism cell such as in an organelle like a plastid or mitochondria.

The sequence of b2366 from *Escherichia coli* (Accession PIR:DWECS) has been published in Blattner et al., Science 277 (5331), 1453-1474 (1997), and its activity is being defined as "D-serine deaminase (dehydratase)". Accordingly, in one embodiment, the process of the present invention comprises the use of a "D-serine deaminase (dehydratase)" or its homolog, e.g. as shown herein, for the production of the fine chemical, meaning of amino acids of the invention, in particular for increasing the amount of citrulline and/or glycine in free or bound form in an organism or a part thereof, as mentioned. In one embodiment, in the process of the present invention the activity of a b2366 protein is increased or generated, e.g. from *Escherichia coli* or a homolog thereof, preferably linked at least to one transit peptide as mentioned for example in table V.

In another embodiment, in the process of the present invention the activity of a b2366 protein is increased or generated in a subcellular compartment of the organism or organism cell such as in an organelle like a plastid or mitochondria.

The sequence of b2600 (Accession number NP_417091) from *Escherichia coli* has been published in Blattner et al., Science 277 (5331), 1453-1474 (1997), and its activity is being defined as "bifunctional chorismate mutase/prephenate dehydrogenase". Accordingly, in one embodiment, the process of the present invention comprises the use of a "bifunctional chorismate mutase/prephenate dehydrogenase" or its homolog, e.g. as shown herein, for the production of the fine chemical, meaning of amino acids of the invention, in particular for increasing the amount of tyrosine in free or bound form in an organism or a part thereof, as mentioned. In one embodiment, in the process of the present invention the activity of a b2600 protein is increased or generated, e.g. from *Escherichia coli* or a homolog thereof, preferably linked at least to one transit peptide as mentioned for example in table V.

In another embodiment, in the process of the present invention the activity of a b2600 protein is increased or generated in a subcellular compartment of the organism or organism cell such as in an organelle like a plastid or mitochondria.

The sequence of b2601 (Accession number NP_417092) from *Escherichia coli* has been published in Blattner et al., Science 277 (5331), 1453-1474 (1997), and its activity is being defined as "3-deoxy-D-arabinoheptulosonate-7-phosphate (DAHP) synthase, tryptophan-repressible". Accordingly, in one embodiment, the process of the present invention comprises the use of a "3-deoxy-D-arabinoheptulosonate-7-phosphate (DAHP) synthase, tryptophan-repressible" or its homolog, e.g. as shown herein, for the production of the fine chemical, meaning of amino acids of the invention, in particular for increasing the amount of phenylalanine and/or tyrosine in free or bound form in an organism or a part thereof, as mentioned. In one embodiment, in the process of the present invention the activity of a b2601 protein is increased or generated, e.g. from *Escherichia coli* or a homolog thereof, preferably linked at least to one transit peptide as mentioned for example in table V.

In another embodiment, in the process of the present invention the activity of a b2601 protein is increased or generated in a subcellular compartment of the organism or organism cell such as in an organelle like a plastid or mitochondria.

The sequence of b2818 (Accession number NP_417295) from *Escherichia coli* has been published in Blattner et al., Science 277 (5331), 1453-1474 (1997), and its activity is being defined as "N-acetylglutamate synthase (amino acids of the invention N-acetyltransferase)". Accordingly, in one embodiment, the process of the present invention comprises the use of a "N-acetylglutamate synthase" or its homolog, e.g. as shown herein, for the production of the fine chemical, meaning of amino acids of the invention, in particular for increasing the amount of citrulline in free or bound form in an organism or a part thereof, as mentioned. In one embodiment, in the process of the present invention the activity of a b2818 protein is increased or generated, e.g. from *Escherichia coli* or a homolog thereof, preferably linked at least to one transit peptide as mentioned for example in table V.

In another embodiment, in the process of the present invention the activity of a b2818 protein is increased or generated in a subcellular compartment of the organism or organism cell such as in an organelle like a plastid or mitochondria.

The sequence of b2965 (Accession number NP_417440) from *Escherichia coli* has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of amino acids of the invention, in particular for increasing the amount of any combination of 2, 3, or all 4 of the fine chemicals, e.g. compounds, selected from the group of "phenylalanine", "alanine", "glycine" and "serine" in free or bound form in an organism or a part thereof, as mentioned. In one embodiment, in the process of the present invention the activity of a b2965 protein is increased or generated, e.g. from *Escherichia coli* or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b3117 (Accession number PIR: DWECTD) from *Escherichia coli* has been published in Blattner et al., Science 277 (5331), 1453-1474 (1997), and its activity is being defined as "threonine dehydratase, catabolic, PLP-dependent". Accordingly, in one embodiment, the process of the present invention comprises the use of a "threonine dehydratase, catabolic, PLP-dependent" or its homolog, e.g. as shown herein, for the production of the fine chemical, meaning of amino acids of the invention, in particular for increasing the amount of citrulline in free or bound form in an organism or a part thereof, as mentioned. In one embodiment, in the process of the present invention the activity of a b3117 protein is increased or generated, e.g. from *Escherichia coli* or a homolog thereof, preferably linked at least to one transit peptide as mentioned for example in table V.

In another embodiment, in the process of the present invention the activity of a b3117 protein is increased or generated in a subcellular compartment of the organism or organism cell such as in an organelle like a plastid or mitochondria.

The sequence of b3213 (Accession number NP_417680) from *Escherichia coli* has been published in Blattner et al., Science 277 (5331), 1453-1474 (1997), and its activity is being defined as "glutamate synthase (small subunit)". Accordingly, in one embodiment, the process of the present invention comprises the use of a glutamate synthase (small subunit)" or its homolog, e.g. as shown herein, for the production of the fine chemical, meaning of amino acids of the invention, in particular for increasing the amount of citrulline in free or bound form in an organism or a part thereof, as mentioned. In one embodiment, in the process of the present invention the activity of a b3213 protein is increased or generated, e.g. from *Escherichia coli* or a homolog thereof, preferably linked at least to one transit peptide as mentioned for example in table V.

In another embodiment, in the process of the present invention the activity of a b3213 protein is increased or generated in a subcellular compartment of the organism or organism cell such as in an organelle like a plastid or mitochondria.

The sequence of b3390 (Accession number YP_026215) from *Escherichia coli* has been published in Blattner et al., Science 277 (5331), 1453-1474 (1997), and its activity is being defined as a "shikimate kinase I". Accordingly, in one embodiment, the process of the present invention comprises the use of a "shikimate kinase I" or its homolog, e.g. as shown herein, for the production of the fine chemical, meaning of amino acids of the invention, in particular for increasing the amount of phenylalanine and/or tyrosine in free or bound form in an organism or a part thereof, as mentioned. In one embodiment, in the process of the present invention the activity of a b3390 protein is increased or generated, e.g. from *Escherichia coli* or a homolog thereof, preferably linked at least to one transit peptide as mentioned for example in table V.

In another embodiment, in the process of the present invention the activity of a b3390 protein is increased or generated in a subcellular compartment of the organism or organism cell such as in an organelle like a plastid or mitochondria. The sequence of b3429 (Accession number NP_417887) from *Escherichia coli* has been published in Blattner et al., Science 277 (5331), 1453-1474 (1997), and its activity is being defined as "glycogen synthase (starch synthase)". Accordingly, in one embodiment, the process of the present invention comprises the use of a "glycogen synthase (starch synthase)" or its homolog, e.g. as shown herein, for the production of the fine chemical, meaning of amino acids of the invention, in particular for increasing the amount of serine in free or bound form in an organism or a part thereof, as mentioned. In one embodiment, in the process of the present invention the activity of a b3429 protein is increased or generated, e.g. from *Escherichia coli* or a homolog thereof, preferably linked at least to one transit peptide as mentioned for example in table V. In another embodiment, in the process of the present invention the activity of a b3429 protein is increased or generated in a subcellular compartment of the organism or organism cell such as in an organelle like a plastid or mitochondria.

The sequence of b3616 (Accession number NP_418073) from *Escherichia coli* has been published in Blattner et al., Science 277 (5331), 1453-1474 (1997), and its activity is being defined as "threonine 3-dehydrogenase, NAD(P)-binding". Accordingly, in one embodiment, the process of the present invention comprises the use of a "threonine 3-dehydrogenase, NAD(P)-binding" or its homolog, e.g. as shown herein, for the production of the fine chemical, meaning of amino acids of the invention, in particular for increasing the amount of serine and/or homoserine in free or bound form in an organism or a part thereof, as mentioned. In one embodiment, in the process of the present invention the activity of a b3616 protein is increased or generated, e.g. from *Escherichia coli* or a homolog thereof, preferably linked at least to one transit peptide as mentioned for example in table V.

In another embodiment, in the process of the present invention the activity of a b3616 protein is increased or generated in a subcellular compartment of the organism or organism cell such as in an organelle like a plastid or mitochondria.

The sequence of b4053 (Accession number PIR:PC1296) from *Escherichia coli* has been published in Blattner et al., Science 277 (5331), 1453-1474 (1997), and its activity is being defined as "alanine racemase, PLP-binding". Accordingly, in one embodiment, the process of the present invention comprises the use of a "alanine racemase, PLP-binding" or its homolog, e.g. as shown herein, for the production of the fine chemical, meaning of amino acids of the invention, in particular for increasing the amount of alanine in free or bound form in an organism or a part thereof, as mentioned. In one embodiment, in the process of the present invention the activity of a b4053 protein is increased or generated, e.g. from *Escherichia coli* or a homolog thereof, preferably linked at least to one transit peptide as mentioned for example in table V.

In another embodiment, in the process of the present invention the activity of a b4053 protein is increased or generated in a subcellular compartment of the organism or organism cell such as in an organelle like a plastid or mitochondria.

The sequence of b4139 (Accession number NP_418562) from *Escherichia coli* has been published in Blattner et al., Science 277 (5331), 1453-1474 (1997), and its activity is being defined as "aspartate ammonia-lyase (aspartase)". Accordingly, in one embodiment, the process of the present invention comprises the use of a "aspartate ammonia-lyase" or its homolog, e.g. as shown herein, for the production of the fine chemical, meaning of amino acids of the invention, in particular for increasing the amount of citrulline and/or serine in free or bound form in an organism or a part thereof, as mentioned. In one embodiment, in the process of the present invention the activity of a b4139 protein is increased or generated, e.g. from *Escherichia coli* or a homolog thereof, preferably linked at least to one transit peptide as mentioned for example in table V.

In another embodiment, in the process of the present invention the activity of a b4139 protein is increased or generated in a subcellular compartment of the organism or organism cell such as in an organelle like a plastid or mitochondria.

The sequence of YAL038W (Accession number NP_009362) from *Saccharomyces cerevisiae* has been published in Goffeau et al., Science 274 (5287), 546-547, 1996 and Bussey et al., Proc. Natl. Acad. Sci. U.S.A. 92 (9), 3809-3813 (1995), and its activity is being defined as "pyruvate kinase", which functions as a homotetramer in glycolysis to convert phosphoenolpyruvate to pyruvate (Cdc19p). Pyruvate is the input for aerobic (TCA cycle) or anaerobic (glucose fermentation) respiration. Accordingly, in one embodiment, the process of the present invention comprises the use of a "pyruvate kinase" or its homolog, e.g. as shown herein, for the production of the fine chemical, meaning of amino acids of the invention, in particular for increasing the amount of alanine and/or phenylalanine in free or bound form in an organism or a part thereof, as mentioned. In one embodiment, in the process of the present invention the activity of a YAL038W protein is increased or generated, e.g. from *Sac-* charomyces cerevisiae or a homolog thereof, preferably linked at least to one transit peptide as mentioned for example in table V.

In another embodiment, in the process of the present invention the activity of an YAL038W protein is increased or generated in a subcellular compartment of the organism or organism cell such as in an organelle like a plastid or mitochondria.

The sequence of YBL082C (Accession number NP_009471) from *Saccharomyces cerevisiae* has been published in Goffeau et al., Science 274 (5287), 546-547, 1996 and Feldmann et al. EMBO J. 13 (24), 5795-5809 (1994), and its activity is being defined as "Dol-P-Man dependent alpha (1-3) mannosyl-transferase". Accordingly, in one embodiment, the process of the present invention comprises the use of a "Dol-P-Man dependent alpha(1-3) mannosyl-transferase" or its homolog, e.g. as shown herein, for the production of the fine chemical, meaning of amino acids of the invention, in particular for increasing the amount of tyrosine in free or bound form in an organism or a part thereof, as mentioned. In one embodiment, in the process of the present invention the activity of a YBL082C protein is increased or generated, e.g. from *Saccharomyces cerevisiae* or a homolog thereof, preferably linked at least to one transit peptide as mentioned for example in table V.

In another embodiment, in the process of the present invention the activity of an YBL082C protein is increased or generated in a subcellular compartment of the organism or organism cell such as in an organelle like a plastid or mitochondria.

The sequence of YDR035W from *Saccharomyces cerevisiae* (NP_010320) has been published in published in Jacq et al., Nature 387 (6632 Suppl), 75-78, 1997 and Goffeau, Science 274 (5287), 546-547, 1996, and its activity is being defined as "3-deoxy-D-arabino-heptulosonate 7-phosphate (DAHP) synthase". Accordingly, in one embodiment, the process of the present invention comprises the use of a "3-deoxy-D-arabino-heptulosonate 7-phosphate (DAHP) synthase" or its homolog, e.g. as shown herein, for the production of the fine chemical, meaning of amino acids of the invention, in particular for increasing the amount of tyrosine and/or phenylalanine in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of a YDR035W protein is increased or generated in a subcellular compartment of the organism or organism cell such as in an organelle like a plastid or mitochondria.

The sequence of YDR430C from *Saccharomyces cerevisiae* (Accession PIR:S69711) has been published in published in Jacq et al., Nature 387 (6632 Suppl), 75-78, 1997 and Goffeau, Science 274 (5287), 546-547, 1996, and its activity is being defined as "Metalloprotease". Accordingly, in one embodiment, the process of the present invention comprises the use of a "Metalloprotease" or its homolog, e.g. as shown herein, for the production of the fine chemical, meaning of amino acids of the invention, in particular for increasing the amount of phenylalanine in free or bound form in an organism or a part thereof, as mentioned. In one embodiment, in the process of the present invention the activity of a YDR430C protein is increased or generated, e.g. from *Saccharomyces cerevisiae* or a homolog thereof, preferably linked at least to one transit peptide as mentioned for example in table V.

In another embodiment, in the process of the present invention the activity of a YDR430C protein is increased or generated in a subcellular compartment of the organism or organism cell such as in an organelle like a plastid or mitochondria.

The sequence of YDR497C (Accession number NP_010785) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "myo-inositol transporter". Accordingly, in one embodiment, the process of the present invention comprises the use of a "myo-inositol transporter" or its homolog, e.g. as shown herein, for the production of the fine chemical, meaning of amino acids of the invention, in particular for increasing the amount of tyrosine in free or bound form in an organism or a part thereof, as mentioned. In one embodiment, in the process of the present invention the activity of a YDR497C protein is increased or generated, e.g. from *Saccharomyces cerevisiae* or a homolog thereof, preferably linked at least to one transit peptide as mentioned for example in table V.

In another embodiment, in the process of the present invention the activity of an YDR497C protein is increased or generated in a subcellular compartment of the organism or organism cell such as in an organelle like a plastid or mitochondria.

The sequence of YEL046C (Accession number NP_010868) from *Saccharomyces cerevisiae* has been published in Goffeau et al., Science 274 (5287), 546-547, 1996 and Dietrich et al., Nature 387 (6632 Suppl), 78-81 (1997), and its activity is being defined as a "L-threonine aldolase", which catalyzes cleavage of L-allo-threonine and L-threonine to Glycine (Gly1p). Accordingly, in one embodiment, the process of the present invention comprises the use of a "low specific L-threonine aldolase" or its homolog, e.g. as shown herein, for the production of the fine chemical, meaning of amino acids of the invention, in particular for increasing the amount of homoserine in free or bound form in an organism or a part thereof, as mentioned. In one embodiment, in the process of the present invention the activity of a YEL046C protein is increased or generated, e.g. from *Saccharomyces cerevisiae* or a homolog thereof, preferably linked at least to one transit peptide as mentioned for example in table V.

In another embodiment, in the process of the present invention the activity of an YEL046C protein is increased or generated in a subcellular compartment of the organism or organism cell such as in an organelle like a plastid or mitochondria.

The sequence of YKR043C (Accession number NP_012969) from *Saccharomyces cerevisiae* has been published in Goffeau et al., Science 274 (5287), 546-547, 1996 and Dujon et al., Nature 369 (6479), 371-378 (1994), and its activity is being defined as a "phosphoglycerate mutase like protein". Accordingly, in one embodiment, the process of the present invention comprises the use of a "phosphoglycerate mutase like protein" or its homolog, e.g. as shown herein, for the production of the fine chemical, meaning of amino acids of the invention, in particular for increasing the amount of serine and/or phenylalanine in free or bound form in an organism or a part thereof, as mentioned. In one embodiment, in the process of the present invention the activity of a YKR043C protein is increased or generated, e.g. from *Saccharomyces cerevisiae* or a homolog thereof, preferably linked at least to one transit peptide as mentioned for example in table V.

In another embodiment, in the process of the present invention the activity of an YKR043C protein is increased or generated in a subcellular compartment of the organism or organism cell such as in an organelle like a plastid or mitochondria.

The sequence of YLR174W (Accession number NP_013275) from *Saccharomyces cerevisiae* has been published in Goffeau et al., Science 274 (5287), 546-547, 1996 and Johnston et al., Nature 387 (6632 Suppl), 87-90 (1997), and its activity is being defined as a "NADP-dependent isocitrate dehydrogenase". Accordingly, in one embodiment, the process of the present invention comprises the use of a "NADP-dependent isocitrate dehydrogenase" or its homolog, e.g. as shown herein, for the production of the fine chemical, meaning of amino acids of the invention, in particular for increasing the amount of tyrosine in free or bound form in an organism or a part thereof, as mentioned. In one embodiment, in the process of the present invention the activity of a YLR174W protein is increased or generated, e.g. from *Saccharomyces cerevisiae* or a homolog thereof, preferably linked at least to one transit peptide as mentioned for example in table V.

In another embodiment, in the process of the present invention the activity of an YLR174W protein is increased or generated in a subcellular compartment of the organism or organism cell such as in an organelle like a plastid or mitochondria.

The sequence of YNL241C from *Saccharomyces cerevisiae* (Accession NP_014158) has been published in published in Jacq et al., Nature 387 (6632 Suppl), 75-78, 1997 and Goffeau, Science 274 (5287), 546-547, 1996, and its activity is being defined as "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of amino acids of the invention, in particular for increasing the amount of alanine and/or tyrosine in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V. In another embodiment, in the process of the present invention the activity of a YNL241C protein is increased or generated in a subcellular compartment of the organism or organism cell such as in an organelle like a plastid or mitochondria.

The sequence of YNR012W (Accession number NP_014409) from *Saccharomyces cerevisiae* has been published in Goffeau et al., Science 274 (5287), 546-547, 1996, and its activity is being defined as "uridine kinase". Accordingly, in one embodiment, the process of the present invention comprises the use of a "uridine kinase" or its homolog, e.g. as shown herein, for the production of the fine chemical, meaning of amino acids of the invention, in particular for increasing the amount of aspartate in free or bound form in an organism or a part thereof, as mentioned. In one embodiment, in the process of the present invention the activity of a YNR012W protein is increased or generated, e.g. from *Saccharomyces cerevisiae* or a homolog thereof, preferably linked at least to one transit peptide as mentioned for example in table V.

In another embodiment, in the process of the present invention the activity of an YNRO12W protein is increased or generated in a subcellular compartment of the organism or organism cell such as in an organelle like a plastid or mitochondria.

The sequence of YOR353C (Accession number NP_014998) from *Saccharomyces cerevisiae* has been published in Goffeau et al., Science 274 (5287), 546-547, 1996, and its activity is being defined as "Protein required for cell morphogenesis and cell separation after mitosis; Sog2p". Accordingly, in one embodiment, the process of the present invention comprises the use of a "Protein required for cell morphogenesis and cell separation after mitosis; Sog2p" or its homolog, e.g. as shown herein, for the production of the fine chemical, meaning of amino acids of the invention, in particular for increasing the amount of phenylalanine in free or bound form in an organism or a part thereof, as mentioned. In one embodiment, in the process of the present invention the activity of a YOR353C protein is increased or generated, e.g. from *Saccharomyces cerevisiae* or a homolog thereof, preferably linked at least to one transit peptide as mentioned for example in table V.

In another embodiment, in the process of the present invention the activity of an YOR353C protein is increased or generated in a subcellular compartment of the organism or organism cell such as in an organelle like a plastid or mitochondria.

In one embodiment, the homolog of the b0342, b0403, b0628, b0754, b0760, b1062, b1136, b1223, b1264, b1556, b1611, b1640, b1704, b1758, b2066, b2223, b2312, b2366, b2600, b2601, b2818, b2965, b3117, b3213, b3390, b3429, b3616, b4053 and/or b4139 is a homolog having said activity and being derived from bacteria. In one embodiment, the homolog of the b0342, b0403, b0628, b0754, b0760, b1062, b1136, b1223, b1264, b1556, b1611, b1640, b1704, b1758, b2066, b2223, b2312, b2366, b2600, b2601, b2818, b2965, b3117, b3213, b3390, b3429, b3616, b4053 and/or b4139 is a homolog having said activity and being derived from Proteobacteria. In one embodiment, the homolog of the b0342, b0403, b0628, b0754, b0760, b1062, b1136, b1223, b1264, b1556, b1611, b1640, b1704, b1758, b2066, b2223, b2312, b2366, b2600, b2601, b2818, b2965, b3117, b3213, b3390, b3429, b3616, b4053 and/or b4139 is a homolog having said activity and being derived from Gammaproteobacteria. In one embodiment, the homolog of the b0342, b0403, b0628, b0754, b0760, b1062, b1136, b1223, b1264, b1556, b1611, b1640, b1704, b1758, b2066, b2223, b2312, b2366, b2600, b2601, b2818, b2965, b3117, b3213, b3390, b3429, b3616, b4053 and/or b4139 is a homolog having said activity and being derived from Enterobacteriales. In one embodiment, the homolog of the b0342, b0403, b0628, b0754, b0760, b1062, b1136, b1223, b1264, b1556, b1611, b1640, b1704, b1758, b2066, b2223, b2312, b2366, b2600, b2601, b2818, b2965, b3117, b3213, b3390, b3429, b3616, b4053 and/or b4139 is a homolog having said activity and being derived from Enterobacteriaceae. In one embodiment, the homolog of the b0342, b0403, b0628, b0754, b0760, b1062, b1136, b1223, b1264, b1556, b1611, b1640, b1704, b1758, b2066, b2223, b2312, b2366, b2600, b2601, b2818, b2965, b3117, b3213, b3390, b3429, b3616, b4053 and/or b4139 is a homolog having said activity and being derived from *Escherichia*, preferably from *Escherichia coli*.

In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from an eukaryotic. In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from Fungi. In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from Ascomyceta. In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from *Saccharomycotina*. In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from *Saccharomycetes*. In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from *Saccharomycetales*. In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from Saccharomycetaceae. In one embodiment, the homolog of the YAL038W, YBL082C, YDR035W, YDR430C, YDR497C, YEL046C, YKR043C, YLR174W, YNL241C, YNR012W and/or YOR353C is a homolog having said activity and being derived from *Saccharomycetes*.

Homologs of the polypeptide disclosed in table II, application no. 13, column 3 may be the polypeptides encoded by the nucleic acid molecules indicated in table I, application no. 13, column 7, resp., or may be the polypeptides indicated in table II, application no. 13, column 7, resp.

for the disclosure of this paragraph see paragraph [0038.0.0.0] above.

In accordance with the invention, a protein or polypeptide has the "activity of an protein as shown in table II, application no. 13, column 3" if its de novo activity, or its increased expression directly or indirectly leads to an increased in the level of the fine chemical indicated in the respective line of table II, application no. 13, column 6 "metabolite" in the organism or a part thereof, preferably in a cell of said organism, more preferably in an organelle such as a plastid or mitochondria of said organism. The protein has the above mentioned activities of a protein as shown in table II, application no. 13, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 13, column 3, or which has at least 10% of the original enzymatic or biological activity, preferably 20%, particularly preferably 30%, most particularly preferably 40% in comparison to a protein as shown in the respective line of table II, application no. 13, column 3 of *E. coli* or *Saccharomyces cerevisiae*.

for the disclosure of the paragraphs [0040.0.0.13] to [0047.0.0.13] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 13, column 3 its biochemical or genetical causes and the increased amount of the respective fine chemical.

for the disclosure of the paragraphs [0049.0.0.13] to [0051.0.0.13] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 13, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.13] to [0058.0.0.13] see paragraphs [0053.0.0.0] to [0058.0.0.0] above.

In case the activity of the *Escherichia coli* protein b0342 or its homologs, e.g. a "thiogalactoside acetyltransferase" is increased advantageously in an organelle such as a plastid or mitochondria, preferably, in one embodiment an increase of the fine chemical, preferably of alanine between 20% and 43% or more is conferred. In case the activity of the *Escherichia coli* protein b0403 or its homologs, e.g. a "maltodextrin glucosidase" is increased advantageously in an organelle such as a plastid or mitochondria, preferably, in one embodiment an increase of the fine chemical, preferably of phenylalanine between 31% and 59% or more is conferred.

In case the activity of the *Escherichia coli* protein b0628 or its homologs, e.g. a "lipoate synthase, an iron-sulfur enzyme" is increased advantageously in an organelle such as a plastid or mitochondria, preferably, in one embodiment an increase of the fine chemical, preferably of homoserine between 34% and 47% or more is conferred.

In case the activity of the *Escherichia coli* protein b0754 or its homologs, e.g. a "3-deoxy-D-arabinoheptulosonate-7-phosphate synthase (DAHP synthetase, phenylalanine-repressible)" is increased advantageously in an organelle such as a plastid or mitochondria, preferably, in one embodiment an increase of the fine chemical, preferably of phenylalanine between 28% and 122% or more is conferred.

In case the activity of the *Escherichia coli* protein b0760 or its homologs, e.g. a "ATP-binding component of molybdate transport system" is increased advantageously in an organelle such as a plastid or mitochondria, preferably, in one embodiment an increase of the fine chemical, preferably of tyrosine between 22% and 37% or more is conferred. In case the activity of the *Escherichia coli* protein b1062 or its homologs, e.g. a "dihydro-orotase" is increased advantageously in an organelle such as a plastid or mitochondria, preferably, in one embodiment an increase of the fine chemical, preferably of alanine between 26% and 61% or more and/or of citrulline between 39% and 90% or more and/or of glycine between 51% and 96% or more and/or of homoserine between 26% and 111% or more and/or of serine between 23% and 48% or more is conferred and/or an increase of any combination of 2, 3, 4 or all 5 of the said fine chemicals, e.g. compounds as mentioned above between 23% and 111% or more is conferred. In case the activity of the *Escherichia coli* protein b1136 or its homologs, e.g. a "isocitrate dehydrogenase (NADP)" is increased advantageously in an organelle such as a plastid or mitochondria, preferably, in one embodiment an increase of the fine chemical, preferably of citrulline between 32% and 60% or more and/or of phenylalanine between 35% and 147% or more is conferred and/or an increase of both of the two said fine chemicals, e.g. compounds as mentioned above between 32% and 147% or more is conferred.

In case the activity of the *Escherichia coli* protein b1223 or its homologs, e.g. a "nitrite extrusion protein" is increased advantageously in an organelle such as a plastid or mitochondria, preferably, in one embodiment an increase of the fine chemical, preferably of glycine between 58% and 122% or more and/or of phenylalanine between 31% and 142% or more is conferred and/or an increase of both of the two said fine chemicals, e.g. compounds as mentioned above between 31% and 142% or more is conferred. In case the activity of the *Escherichia coli* protein b1264 or its homologs, e.g. an "anthranilate synthase component I" is increased advantageously in an organelle such as a plastid or mitochondria, preferably, in one embodiment an increase of the fine chemical, preferably of alanine between 21% and 55% or more and/or of citrulline between 38% and 63% or more and/or of glycine between 37% and 73% or more and/or of homoserine between 25% and 44% or more and/or of serine between 35% and 96% or more is conferred and/or an increase of any combination of 2, 3, 4 or all 5 of the said fine chemicals, e.g. compounds as mentioned above between 21% and 96% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of aspartate (aspartic acid) between 58% and 197% or more is conferred.

In case the activity of the *Escherichia coli* protein b1611 or its homologs, e.g. a "fumarase C (fumarate hydratase Class II)" is increased advantageously in an organelle such as a plastid or mitochondria, preferably, in one embodiment an increase of the fine chemical, preferably of serine between 24% and 41% or more is conferred.

In case the activity of the *Escherichia coli* protein b1640 or its homologs, e.g. a "conserved hypothetical protein with actin-like ATPase domain" is increased advantageously in an organelle such as a plastid or mitochondria, preferably, in one embodiment an increase of the fine chemical, preferably of 5-oxoproline between 24% and 33% or more and/or of aspartate between 46% and 60% or more is conferred and/or an increase of both of the two said fine chemicals, e.g. compounds as mentioned above between 24% and 60% or more is conferred.

In case the activity of the *Escherichia coli* protein b1704 or its homologs, e.g. a "3-deoxy-D-arabinoheptulosonate-7-phosphate synthase (DAHP synthetase), tryptophanrepressible" is increased advantageously in an organelle such as a plastid or mitochondria, preferably, in one embodiment an increase of the fine chemical, preferably of phenylalanine between 43% and 38655% or more and/or of tyrosine between 1014% and 10359% or more is conferred and/or an increase of both of the two said fine chemicals, e.g. compounds as mentioned above between 43% and 38655% or more is conferred.

In case the activity of the *Escherichia coli* protein b1758 or its homologs, e.g. a "cytochrome oxidase" is increased advantageously in an organelle such as a plastid or mitochondria, preferably, in one embodiment an increase of the fine chemical, preferably of aspartate between 51% and 109% or more and/or of citrulline between 40% and 96% or more and/or of serine between 24% and 47% or more is conferred and/or an increase of any combination of two or of all 3 of the said fine chemicals, e.g. compounds as mentioned above between 24% and 109% or more is conferred.

In case the activity of the *Escherichia coli* protein b2066 or its homologs, e.g. an "uridine/cytidine kinase" is increased advantageously in an organelle such as a plastid or mitochondria, preferably, in one embodiment an increase of the fine chemical, preferably of aspartate between 48% and 133% or more is conferred.

In case the activity of the *Escherichia coli* protein b2223 or its homologs, e.g. a "short chain fatty acid transporter" is increased advantageously in an organelle such as a plastid or mitochondria, preferably, in one embodiment an increase of the fine chemical, preferably of tyrosine between 39% and 77% or more is conferred.

In case the activity of the *Escherichia coli* protein b2312 or its homologs, e.g. a "amidophosphoribosyltransferase (PRPP amidotransferase)" is increased advantageously in an organelle such as a plastid or mitochondria, preferably, in one embodiment an increase of the fine chemical, preferably of aspartate between 52% and 114% or more is conferred.

In case the activity of the *Escherichia coli* protein b2366 or its homologs, e.g. a "D-serine deaminase (dehydratase)" is increased advantageously in an organelle such as a plastid or mitochondria, preferably, in one embodiment an increase of the fine chemical, preferably of citrulline between 32% and 66% or more and/or of glycine between 43% and 98% or more is conferred and/or an increase of both of the two said fine chemicals, e.g. compounds as mentioned above between 43% and 98% or more is conferred.

In case the activity of the *Escherichia coli* protein b2600 or its homologs, e.g. a "bifunctional chorismate mutase/prephenate dehydrogenase" is increased advantageously in an organelle such as a plastid or mitochondria, preferably, in one embodiment an increase of the fine chemical, preferably of tyrosine between 159% and 378% or more is conferred.

In case the activity of the *Escherichia coli* protein b2601 or its homologs, e.g. a "3-deoxy-D-arabinoheptulosonate-7-phosphate (DAHP) synthase" is increased advantageously in an organelle such as a plastid or mitochondria, preferably, in one embodiment an increase of the fine chemical, preferably of phenylalanine between 152% and 2064% or more and/or of tyrosine between 132% and 1567% or more is conferred and/or an increase of both of the two said fine chemicals, e.g. compounds as mentioned above between 132% and 2064% or more is conferred.

In case the activity of the *Escherichia coli* protein b2818 or its homologs, e.g. a "N-acetylglutamate synthase" is increased advantageously in an organelle such as a plastid or mitochondria, preferably, in one embodiment an increase of the fine chemical, preferably of citrulline between 181% and 328% or more is conferred.

In case the activity of the *Escherichia coli* protein b2965 or its homologs, e.g. an "ornithine decarboxylase" is increased advantageously in an organelle such as a plastid or mitochondria, preferably, in one embodiment an increase of the fine chemical, preferably of alanine between 21% and 72% or more and/or of glycine between 52% and 198% or more and/or of phenylalanine between 31% and 204% or more and/or of serine between 33% and 193% or more is conferred and/or an increase of any combination of 2, 3 or of all 4 of the said fine chemicals, e.g. compounds as mentioned above between 21% and 204% or more is conferred.

In case the activity of the *Escherichia coli* protein b3117 or its homologs, e.g. a "threonine dehydratase, catabolic, PLP-dependent" is increased advantageously in an organelle such as a plastid or mitochondria, preferably, in one embodiment an increase of the fine chemical, preferably of citrulline between 43% and 166% or more is conferred.

In case the activity of the *Escherichia coli* protein b3213 or its homologs, e.g. a "glutamate synthase (small subunit)" is increased advantageously in an organelle such as a plastid or mitochondria, preferably, in one embodiment an increase of the fine chemical, preferably of citrulline between 32% and 56% or more is conferred.

In case the activity of the *Escherichia coli* protein b3390 or its homologs, e.g. a "shikimate kinase I" is increased advantageously in an organelle such as a plastid or mitochondria, preferably, in one embodiment an increase of the fine chemical, preferably of phenylalanine between 100% and 241% or more and/or of tyrosine between 100% and 189% or more is conferred and/or an increase of both of the two said fine chemicals, e.g. compounds as mentioned above between 100% and 241% or more is conferred.

In case the activity of the *Escherichia coli* protein b3429 or its homologs, e.g. a "glycogen synthase (starch synthase)" is increased advantageously in an organelle such as a plastid or mitochondria, preferably, in one embodiment an increase of the fine chemical, preferably of serine between 25% and 70% or more is conferred.

In case the activity of the *Escherichia coli* protein b3616 or its homologs, e.g. a "threonine 3-dehydrogenase, NAD(P)-binding" is increased advantageously in an organelle such as a plastid or mitochondria, preferably, in one embodiment an increase of the fine chemical, preferably of homoserine between 26% and 101% or more and/or of serine between 23% and 87% or more is conferred and/or an increase of both of the two said fine chemicals, e.g. compounds as mentioned above between 23% and 101% or more is conferred.

In case the activity of the *Escherichia coli* protein b4053 or its homologs, e.g. a "alanine racemase, PLP-binding" is increased advantageously in an organelle such as a plastid or mitochondria, preferably, in one embodiment an increase of the fine chemical, preferably of alanine between 35% and 129% or more is conferred.

In case the activity of the *Escherichia coli* protein b4139 or its homologs, e.g. a aspartate ammonia-lyase (aspartase)" is increased advantageously in an organelle such as a plastid or mitochondria, preferably, in one embodiment an increase of the fine chemical, preferably of citruline between 145% and 522% or more and/or of serine between 130% and 478% or more is conferred and/or an increase of both of the two said fine chemicals, e.g. compounds as mentioned above between 145% and 522% or more is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably of alanine between 27% and 170% or more or phenylalanine between 25% and 51% or more is conferred and/or an increase of both of the two said fine chemicals, e.g. compounds as mentioned above between 25% and 170% or more is conferred.

In case the activity of the *Saccharomyces cerevisiae* protein YBL082C or its homologs, e.g. a "Dol-P-Man dependent alpha(1-3) mannosyl-transferase" is increased advantageously in an organelle such as a plastid or mitochondria, preferably, in one embodiment an increase of the fine chemical, preferably of tyrosine between 30% and 61% or more is conferred.

In case the activity of the *Saccharomyces cerevisiae* protein YDR035W or its homologs, e.g. a "3-deoxy-D-arabinoheptulosonate-7-phosphate synthase" is increased advantageously in an organelle such as a plastid or mitochondria, preferably, in one embodiment an increase of the fine chemical, preferably of phenylalanine between 40% and 2244% or more or tyrosine between 43% and 509% or more is conferred and/or an increase of both of the two said fine chemicals, e.g. compounds as mentioned above between 40% and 2244% or more is conferred.

In case the activity of the *Saccharomyces cerevisiae* protein YDR430C or its homologs, e.g. a "Metalloprotease" is increased advantageously in an organelle such as a plastid or mitochondria, preferably, in one embodiment an increase of the fine chemical, preferably of phenylalanine between 38% and 131% or more is conferred.

In case the activity of the *Saccharomyces cerevisiae* protein YDR497C or its homologs, e.g. a "myo-inositol transporter" is increased advantageously in an organelle such as a plastid or mitochondria, preferably, in one embodiment an increase of the fine chemical, preferably of tyrosine between 38% and 46% or more is conferred.

In case the activity of the *Saccharomyces cerevisiae* protein YEL046C or its homologs, e.g. a "L-threonine aldolase" is increased advantageously in an organelle such as a plastid or mitochondria, preferably, in one embodiment an increase of the fine chemical, preferably of homoserine between 26% and 117% or more is conferred.

In case the activity of the *Saccaromyces cerevisiae* protein YKR043C or its homologs, e.g. a "YKR043C protein activity" is increased, preferably, in one embodiment the increase of the fine chemical, preferably of phenylalanine between 35% and 340% or more or serine between 26% and 60% or more is conferred and/or an increase of both of the two said fine chemicals, e.g. compounds as mentioned above between 26% and 340% or more is conferred.

In case the activity of the *Saccharomyces cerevisiae* protein YLR174W or its homologs, e.g. a "cytosolic NADP-specific isocitrate dehydrogenase" is increased advantageously in an organelle such as a plastid or mitochondria, preferably, in one embodiment an increase of the fine chemical, preferably of tyrosine between 20% and 25% or more is conferred.

In case the activity of the *Saccharomyces cerevisiae* protein YNL241C or its homologs, e.g. a "glucose-6-phosphate dehydrogenase" is increased advantageously in an organelle such as a plastid or mitochondria, preferably, in one embodiment an increase of the fine chemical, preferably of lalanine between 66% and 115% or more or tyrosine between 29% and 35% or more is conferred and/or an increase of both of the two said fine chemicals, e.g. compounds as mentioned above between 29% and 115% or more is conferred.

In case the activity of the *Saccharomyces cerevisiae* protein YNR012W or its homologs, e.g. a "uridine kinase" is increased advantageously in an organelle such as a plastid or mitochondria, preferably, in one embodiment an increase of the fine chemical, preferably of aspartate between 48% and 73% or more is conferred.

In case the activity of the *Saccharomyces cerevisiae* protein YOR353C or its homologs, e.g. a "Protein required for cell morphogenesis and cell separation after mitosis; Sog2p" is increased advantageously in an organelle such as a plastid or mitochondria, preferably, in one embodiment an increase of the fine chemical, preferably phenylalanine between 41% and 106% or more is conferred.

In one embodiment, the activity of any on of the *Escherichia coli* proteins b0342, b0403, b0628, b0754, b0760, b1062, b1136, b1223, b1264, b1556, b1611, b1640, b1704, b1758, b2066, b2223, b2312, b2366, b2600, b2601, b2818, b2965, b3117, b3213, b3390, b3429, b3616, b4053 and/or b4139 and/or the activity of any on of the *Saccharomyces cerevisiae* proteins YAL038W, YBL082C, YDR035W, YDR430C, YDR497C, YEL046C, YKR043C, YLR174W, YNL241C, YNR012W and/or YOR353C or their homologs, is advantageously increased in an organelle such as a plastid or mitochondria, preferably conferring an increase of the fine chemical indicated in column 6 "metabolites" for application no. 14 in any one of Tables I to IV, resp.

for the disclosure of the paragraphs [0061.0.0.13] and [0062.0.0.13] see paragraphs [0061.0.0.0] and [0062.0.0.0] above.

A protein having an activity conferring an increase in the amount or level of the fine chemical, preferably upon targeting to the plastids, has in one embodiment the structure of the polypeptide described herein, in particular of the polypeptides comprising the consensus sequence shown in table IV, application no. 14, column 7 or of the polypeptide as shown in the amino acid sequences as disclosed in table II, application no. 14, columns 5 and 7 or the functional homologues thereof as described herein, or is encoded by the nucleic acid molecule characterized herein or the nucleic acid molecule according to the invention, for example by the nucleic acid molecule as shown in table I, application no. 14, columns 5 and 7 or its herein described functional homologues and has the herein mentioned activity.

For the purposes of the present invention, the terms "5-oxo-proline", "alanine", "aspartic acid", "citrulline", "glycine", "homoserine", "phenylalanine", "serine" and/or "tyrosine" also encompass the corresponding salts, such as, for example resulting in the reaction with acids like hydrochloride or the different sulphur containing acids.

for the disclosure of the paragraphs [0065.0.0.13] and [0066.0.0.13] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 14, columns 5 and 7 or its homologs activity having herein-mentioned amino acids of the invention increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 14, columns 5 and 7, e.g. a nucleic acid sequence encoding a polypeptide having the activity of a protein as indicated in table II, application no. 14, columns 5 and 7 or its homologs activity or of a mRNA encoding the polypeptide of the present invention having herein-mentioned amino acids of the invention increasing activity; and/or c) increasing the specific activity of a protein conferring the increased expression of a protein encoded by the nucleic acid molecule of the invention or of the polypeptide of the present invention having herein-mentioned sterol increasing activity, e.g. of a polypeptide having the activity of a protein as indicated in table II, application no. 14, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned amino acids of the invention increasing activity, e.g. of a polypeptide having the activity of a protein as indicated in table II, application no. 14, columns 5 and 7 or its homologs activity; and/or e) stimulating activity of a protein conferring the increased expression of a protein encoded by the nucleic acid molecule of the present invention or a polypeptide of the present invention having herein-mentioned amino acids of the invention increasing activity, e.g. of a polypeptide having the activity of a protein as indicated in table II, application no. 14, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned amino acids of the invention increasing activity, e.g. of a polypeptide having the activity of a protein as indicated in table II, application no. 14, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned amino acids of the invention increasing activity, e.g. of a polypeptide having the activity of a protein as indicated in table II, application no. 14, columns 5 and 7 or its homologs activity; and/or h) increasing the expression of the endogenous gene encoding the polypeptide of the invention, e.g. a polypeptide having the activity of a protein as indicated in table II, application no. 14, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned amino acids of the invention increasing activity, e.g. of polypeptide having the activity of a protein as indicated in table II, application no. 14, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned amino acids of the invention increasing activity, e.g. of a polypeptide having the activity of a protein as indicated in table II, application no. 14, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned amino acids of the invention increasing activity, e.g. of a polypeptide having the activity of a protein as indicated in table II, application no. 14, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the respective fine chemical as indicated in column 6 of application no. 14 in Table I to IV, resp., after increasing the expression or activity of the encoded polypeptide preferably in organelles such as plastids or having the activity of a polypeptide having an activity as the protein as shown in table II, application no. 14, column 3 or its homologs. Preferably the increase of the fine chemical takes place in plastids.

for the disclosure of the paragraphs [0069.0.0.13] to [0079.0.0.13] see paragraphs [0069.0.0.0] to [0079.0.0.0] above.

The activation of an endogenous polypeptide having above-mentioned activity, e.g. having the activity of a protein as shown in table II, application no. 14, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 14, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 13, column 3. The expression of the chimeric transcription factor in a organism, in particular in a plant, leads to a specific expression of the protein as shown in table II, application no. 13, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

For the disclosure of the paragraphs [0081.0.0.13] to [0084.0.0.13] see paragraphs [0081.0.0.0] to [0084.0.0.0] above.

Owing to the introduction of a gene or a plurality of genes conferring the expression of the nucleic acid molecule of the invention or the polypeptide of the invention, for example the nucleic acid construct mentioned below, or encoding the protein as shown in table II, application no. 14, column 3 into an organism alone or in combination with other genes, it is possible not only to increase the biosynthetic flux towards the end product, but also to increase, modify or create de novo an advantageous, preferably novel metabolite composition in the organism, e.g. an advantageous amino acid composition comprising a higher content of (from a viewpoint of nutrional physiology limited) amino acids alone or in combination in free or bound form.

for the disclosure of this paragraph see paragraph [0086.0.0.0] above.

By influencing the metabolism thus, it is possible to produce, in the process according to the invention, further advantageous compounds. Examples of such compounds are, in addition to 5-oxoproline, alanine, aspartic acid, citrulline, glycine, homoserine, phenylalanine, serine and/or tyrosine further amino acids or the respective precursors or catabolic products.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 14, column 3 or of a polypeptide being encoded by the nucleic acid molecule of the present invention and described below, e.g. conferring an increase of the respective fine chemical as indicated in any one of Tables I to IV, application no. 14, column 6 "metabolite" in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and d) if desired, recovering, optionally isolating, the respective free and/or bound the fine chemical as indicated in any one of Tables I to IV, application no. 14, column 6 "metabolite" and, optionally further free and/or bound amino acids, synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound fine chemical but as option it is also possible to produce, recover and, if desired isolate, other free or/and bound amino acids for example in form of proteins. Such an concomitant increase of protein bound amino acids after enhancing the biosynthesis of an amino acid has previously been described. For example, Galili et al., Transgenic Res., 200, 9, 2, 137-144 reported that the heterologous expression of a bacterial gene for the amino acid biosynthesis confers the increase of free as well as of protein-bound amino acids.

for the disclosure of the paragraphs [0090.0.0.13] to [0097.0.0.13] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 14, columns 5 and 7 or a derivative thereof, or b) a genetic regulatory element, for example a promoter, which is functionally linked to the nucleic acid sequence as shown table I, application no. 14, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 14, columns 5 and 7 joined to a nucleic acid sequence encoding a transit peptide, or a targeting nucleic acid sequence which directs the nucleic acid sequences disclosed in table I, application no. 14, columns 5 and 7 to the organelle preferentially the plastids. Altenatively the inventive nucleic acids sequences consist advantageously of the nucleic acid sequences as depicted in the sequence protocol and disclosed in table I, application no. 14, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph [0100.0.0.13] see paragraph [0100.0.0.0] above.

In an advantageous embodiment of the invention, the organism takes the form of a plant whose amino acid content is modified advantageously owing to the nucleic acid molecule of the present invention expressed. This is important for plant breeders since, for example, the nutritional value of plants for animals is limited by a few amino acids.

for the disclosure of the paragraphs [0102.0.0.13] to [0110.0.0.13] see paragraphs [0102.0.0.0] to [0110.0.0.0] above.

In a preferred embodiment, the respective fine chemical as indicated in any one of Tables I to IV, application no. 14, column 6 "metabolite" (5-oxoproline, alanine, aspartic acid, citrulline, glycine, homoserine, phenylalanine, serine and/or tyrosine) is produced in accordance with the invention and, if desired, is isolated. The production of further amino acidsor mixtures thereof or mixtures with other compounds by the process according to the invention is advantageous.

Thus, the content of plant components and preferably also further impurities is as low as possible, and the abovementioned amino acids are obtained in as pure form as possible. In these applications, the content of plant components advantageously amounts to less than 10%, preferably 1%, more preferably 0.1%, very especially preferably 0.01% or less.

for the disclosure of the paragraphs [0112.0.0.13] to [0115.0.0.13] see paragraphs [0112.0.0.0] to [0115.0.0.0] above.

In a preferred embodiment, the present invention relates to a process for the production of the respective fine chemical as indicated for application no. 14 in any one of Tables I to IV, column 6 "metabolite", comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 14, columns 5 and 7 or a fragment thereof, which confers an increase in the amount of the respective fine chemical in an organism or a part thereof;

b) nucleic acid molecule comprising, preferably at least the mature form, of the nucleic acid molecule shown in table I, application no. 14, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybidizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;

h) nucleic acid molecule comprising a nucleic acid molecule which is obtained by amplifying nucleic acid molecules from a cDNA library or a genomic library using the primers shown in table III, application no. 14, column 7 and conferring an increase in the amount of the respective fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;

j) nucleic acid molecule which encodes a polypeptide comprising the consensus sequence shown in table IV, application no. 14, column 7 and conferring an increase in the amount of the respective fine chemical in an organism or a part thereof;

k) nucleic acid molecule comprising one or more of the nucleic acid molecule encoding the amino acid sequence of a polypeptide encoding a domain of the polypeptide shown in table II, application no. 14, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in table IA, application no. 14, columns 5 and 7 by one or more nucleotides. In one embodiment, the nucleic acid molecule used in the process of the invention does not consist of the sequence indicated in table IA, application no. 14, columns 5 and 7. In one embodiment, the nucleic acid molecule used in the process of the invention is less than 100%, 99.999%, 99.99%, 99.9% or 99% identical to a sequence indicated in table IA, application no. 14, columns 5 and 7. In another embodiment, the nucleic acid molecule does not encode a polypeptide of a sequence indicated in table IIA, application no. 14, columns 5 and 7.

In one embodiment, the nucleic acid molecule used in the process of the invention distinguishes over the sequence indicated in table IB, application no. 14, columns 5 and 7, by one or more nucleotides. In one embodiment, the nucleic acid molecule used in the process of the invention does not consist of the sequence indicated in table IB, application no. 14, columns 5 and 7. In one embodiment, the nucleic acid molecule used in the process of the invention is less than 100%, 99.999%, 99.99%, 99.9% or 99% identical to a sequence indicated in table IB, application no. 14, columns 5 and 7. In another embodiment, the nucleic acid molecule does not encode a polypeptide of a sequence indicated in table IIB, application no. 14, columns 5 and 7.

In one embodiment, the nucleic acid molecule used in the process distinguishes over the sequence shown in table I, application no. 14, columns 5 and 7 by one or more nucleotides or does not consist of the sequence shown in table I, application no. 14, columns 5 and 7. In one embodiment, the nucleic acid molecule of the present invention is less than 100%, 99.999%, 99.99%, 99.9% or 99% identical to the sequence shown in table I, application no. 14, columns 5 and 7. In another embodiment, the nucleic acid molecule does not encode a polypeptide of the sequence shown in table II, application no. 14, columns 5 and 7.

for the disclosure of the paragraphs [0118.0.0.13] to [0120.0.0.13] see paragraphs [0118.0.0.0] to [0120.0.0.0] above.

The expression of nucleic acid molecules with the sequence shown in table I, application no. 14, columns 5 and 7, or nucleic acid molecules which are derived from the amino acid sequences shown in table II, application no. 14, columns 5 and 7 or from polypeptides comprising the consensus sequence shown in table IV, application no. 14, column 7, or their derivatives or homologues encoding polypeptides with the enzymatic or biological activity of a protein as shown in table II, application no. 14, column 3, and conferring an increase of the respective fine chemical (column 6 of application no. 14 in any one of Tables I to IV) after increasing its plastidic expression and/or specific activity in the plastids is advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 14, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 14, column 3 and which confer an increase in the level of the respective fine chemical indicated in table II, application no. 14, column 6 by being expressed either in the cytsol or in an organelle such as a plastid or mitochondria or both, preferably in plastids, and the gene product being localized in the plastid and other parts of the cell or in the plastid as described above.

for the disclosure of the paragraphs [0126.0.0.13] to [0133.0.0.13] see paragraphs [0126.0.0.0] to [0133.0.0.0] above.

Production strains which are also advantageously selected in the process according to the invention are microorganisms selected from the group of green algae, like *Spongioccoccum exentricum, Chlorella sorokiniana* (pyrenoidosa, Jul. 11, 2005), or algae of the genus *Haematococcus, Phaedactylum tricornatum, Volvox* or *Dunaliella* or form the group of fungi like fungi belonging to the *Daccrymycetaceae* family, or non-photosynthetic bacteria, like methylotrophs, flavobacteria, actinomycetes, like streptomyces chrestomyceticus, Mycobacteria like *Mycobacterim phlei, Rhodobacter capsulatus,* or *Brevibacterium linens, Dunaliella* spp., *Phaffia rhodozyma, Phycomyces* sp., *Rhodotorula* spp. Thus, the invention also contemplates embodiments in which a host lacks sterols or sterols precursors, such as the vinca. In a plant of the latter type, the inserted DNA includes genes that code for proteins producing sterols precursors (compounds that can be converted biologically into a compound with sterols activity) and one or more modifiying enzymes which were originally absent in such a plant.

The invention also contemplates embodiments in which the amino acids of the invention or amino acids of the invention precursor compounds in the production of the respective fine chemical, are present in a photosynthetic active organisms chosen as the host; for example, cyanobacteria, moses, algae or plants which, even as a wild type, are capable of producing the amino acids of the invention.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 14, columns 5 and 7 or the functional homologues thereof as described herein, preferably conferring above-mentioned activity, i.e. conferring an increase of the respective fine chemical after increasing its plastidic activity, e.g. after increasing the activity of a protein as shown in table II, application no. 14, column 3 by—for example—expression either in the cytsol or in an organelle such as a plastid or mitochondria or both, preferably in plastids and the gene product, e.g. the polypeptide, being localized in the plastid and other parts of the cell or in the plastid as described above.

for the disclosure of the paragraphs [0135.0.0.13] to [0140.0.0.13] see paragraphs [0135.0.0.0] to [0140.0.0.0] above.

Synthetic oligonucleotide primers for the amplification, e.g. as shown in table III, application no. 14, column 7, by means of polymerase chain reaction can be generated on the basis of a sequence shown herein, for example the sequence shown in table I, application no. 14, columns 5 and 7 or the sequences derived from table II, application no. 14, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequences shown in table IV, application no. 14, column 7 are derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 14, column 3 or further functional homologs of the polypeptide of the invention from other organisms.

for the disclosure of the paragraphs [0144.0.0.13] to [0151.0.0.13] see paragraphs [0144.0.0.0] to [0151.0.0.0] above.

Polypeptides having above-mentioned activity, i.e. conferring the increase of the respective fine chemical indicated in table I, application no. 14, column 6, and being derived from other organisms, can be encoded by other DNA sequences which hybridize to the sequences shown in table I, application no. 14, columns 5 and 7, preferably of table IB, application no. 14, columns 5 and 7 under relaxed hybridization conditions and which code on expression for peptides having the respective fine chemical, i.e. amino acids of the invention increasing activity, when expressed in a way that the gene product, e.g. the polypeptide, being localized in the plastid and other parts of the cell or in the plastid as described above.

For the disclosure of the paragraphs [0153.0.0.13] to [0159.0.0.13] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 14, columns 5 and 7, preferably shown in table IB, application no. 14, columns 5 and 7 is one which is sufficiently complementary to one of the nucleotide sequences shown in table I, application no. 14, columns 5 and 7, preferably shown in table IB, application no. 14, columns 5 and 7 such that it can hybridize to one of the nucleotide sequences shown in table I, application no. 14, columns 5 and 7, preferably shown in table IB, application no. 14, columns 5 and 7, thereby forming a stable duplex. Preferably, the hybridisation is performed under stringent hybridisation conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 14, columns 5 and 7, preferably shown in table IB, application no. 14, columns 5 and 7, or a portion thereof and preferably has above mentioned activity, in particular having a respective fine chemical increasing activity after increasing the activity or an activity of a gene product as shown in table II, application no. 14, column 3 by for example expression either in the cytsol or in an organelle such as a plastid or mitochondria or both, preferably in plastids, and the gene product, e.g. the polypeptide, being localized in the plastid and other parts of the cell or in the plastid as described above.

The nucleic acid molecule of the invention comprises a nucleotide sequence which hybridizes, preferably hybridizes under stringent conditions as defined herein, to one of the nucleotide sequences shown in table I, application no. 14, columns 5 and 7, preferably shown in table IB, application no. 14, columns 5 and 7, or a portion thereof and encodes a protein having above-mentioned activity, e.g. conferring of a 5-oxoproline, alanine, aspartic acid (aspartate), citrulline, glycine, homoserine, phenylalanine, serine and/or tyrosineincrease by for example expression either in the cytsol or in an organelle such as a plastid or mitochondria or both, preferably in plastids, and optionally, the activity of a protein as shown in table II, application no. 14, column 3, and the gene product, e.g. the polypeptide, being localized in the plastid and other parts of the cell or in the plastid as described above.

Moreover, the nucleic acid molecule of the invention can comprise only a portion of the coding region of one of the sequences shown in table I, application no. 1314 columns 5 and 7, preferably shown in table IB, application no. 14, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the respective fine chemical indicated in Table I, application no. 14, column 6, if its activity is increased by for example expression either in the cytsol or in an organelle such as a plastid or mitochondria or both, preferably in plastids, and the gene product, e.g. the polypeptide, being localized in the plastid and other parts of the cell or in the plastid as described above. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 14, columns 5 and 7, an anti-sense sequence of one of the sequences, e.g., set forth in table I, application no. 14, columns 5 and 7, preferably shown in table IB, application no. 14, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 14, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 14, columns 5 and 7 such that the protein or portion thereof maintains the ability to participate in the fine chemical production, in particular an activity increasing the level of 5-oxoproline, alanine, aspartic acid (aspartate), citrulline, glycine, homoserine, phenylalanine, serine and/or tyrosine, increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 14, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 14, columns 5 and 7 and having above-mentioned activity, e.g. conferring preferably the increase of the respective fine chemical by for example expression either in the cytsol or in an organelle such as a plastid or mitochondria or both, preferably in plastids, and the gene product, e.g. the polypeptide, being localized in the plastid and other parts of the cell or in the plastid as described above.

for the disclosure of the paragraphs [0168.0.0.13] and [0169.0.0.13] see paragraphs [0168.0.0.0] and [0169.0.0.0] above.

The invention further relates to nucleic acid molecules that differ from one of the nucleotide sequences shown in table I, application no. 14, columns 5 and 7 (and portions thereof) due to degeneracy of the genetic code and thus encode a polypeptide of the present invention, in particular a polypeptide having above mentioned activity, e.g. conferring an increase in the respective fine chemical in a organism, e.g. as that polypeptides depicted by the sequence shown in table II, application no. 14, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 14, columns 5 and 7 or the functional homologues. In a still further embodiment, the nucleic acid molecule of the invention encodes a full length protein which is substantially homologous to an amino acid sequence shown in table II, application no. 14, columns 5 and 7 or the functional homologues. However, in a preferred embodiment, the nucleic acid molecule of the present invention does not consist of the sequence shown in table I, application no. 14, columns 5 and 7, preferably as indicated in table IA, application no. 14, columns 5 and 7. Preferably the nucleic acid molecule of the invention is a functional homologue or identical to a nucleic acid molecule indicated in table IB, application no. 14, columns 5 and 7.

for the disclosure of the paragraphs [0171.0.0.13] to [0173.0.0.13] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 14, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 14, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 14, columns 5 and 7.

For the disclosure of the paragraphs [0179.0.0.13] and [0180.0.0.13] see paragraphs [0179.0.0.0] and [0180.0.0.0] above.

Accordingly, the invention relates to nucleic acid molecules encoding a polypeptide having above-mentioned activity, e.g. conferring an increase in the the respective fine chemical in an organisms or parts thereof by for example expression either in the cytsol or in an organelle such as a plastid or mitochondria or both, preferably in plastids (as described), that contain changes in amino acid residues that are not essential for said activity. Such polypeptides differ in amino acid sequence from a sequence contained in the sequences shown in table II, application no. 14, columns 5 and 7, preferably shown in table IIA, application no. 14, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 14, columns 5 and 7, preferably shown in table IIA, application no. 14, columns 5 and 7 and is capable of participation in the increase of production of the fine chemical after increasing its activity, e.g. its expression by for example expression either in the cytsol or in an organelle such as a plastid or mitochondria or both, preferably in plastids and the gene product, e.g. the polypeptide, being localized in the plastid and other parts of the cell or in the plastid as described above. Preferably, the protein encoded by the nucleic acid molecule is at least about 60% identical to the sequence shown in table II, application no. 14, columns 5 and 7, preferably shown in table IIA, application no. 14, columns 5 and 7, more preferably at least about 70% identical to one of the sequences shown in table II, application no. 14, columns 5 and 7, preferably shown in table IIA, application no. 14, columns 5 and 7, even more preferably at least about 80%, 90%, 95% homologous to the sequence shown in table II, application no. 14, columns 5 and 7, preferably shown in table IIA, application no. 13, columns 5 and 7, and most preferably at least about 96%, 97%, 98%, or 99% identical to the sequence shown in table II, application no. 14, columns 5 and 7, preferably shown in table IIA, application no. 14, columns 5 and 7.

for the disclosure of the paragraphs [0182.0.0.13] to [0188.0.0.13] see paragraphs [0182.0.0.0] to [0188.0.0.0] above.

Functional equivalents derived from one of the polypeptides as shown in table II, application no. 14, columns 5 and 7, preferably shown in table IIB, application no. 14, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 14, columns 5 and 7, preferably shown in table IIB, application no. 14, columns 5 and 7 resp., according to the invention and are distinguished by essentially the same properties as the polypeptide as shown in table II, application no. 14, columns 5 and 7, preferably shown in table IIB, application no. 14, columns 5 and 7.

Functional equivalents derived from the nucleic acid sequence as shown in table I, application no. 14, columns 5 and 7, preferably shown in table IB, application no. 14, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 14, columns 5 and 7, preferably shown in table IIB, application no. 14, columns 5 and 7 resp., according to the invention and encode polypeptides having essentially the same properties as the polypeptide as shown in table II, application no. 14, columns 5 and 7, preferably shown in table IIB, application no. 14, columns 5 and 7.

for the disclosure of this paragraph see paragraph [0191.0.0.0] above.

A nucleic acid molecule encoding an homologous to a protein sequence of table II, application no. 14, columns 5 and 7, preferably shown in table IIB, application no. 14, columns 5 and 7 resp., can be created by introducing one or more nucleotide substitutions, additions or deletions into a nucleotide sequence of the nucleic acid molecule of the present invention, in particular of table I, application no. 14, columns 5 and 7, preferably shown in table IB, application no. 14, columns 5 and 7 resp., such that one or more amino acid substitutions, additions or deletions are introduced into the encoded protein. Mutations can be introduced into the encoding sequences of table I, application no. 14, columns 5 and 7, preferably shown in table IB, application no. 14, columns 5 and 7 resp., by standard techniques, such as site-directed mutagenesis and PCR-mediated mutagenesis.

for the disclosure of the paragraphs [0193.0.0.1 3] to [0196.0.0.13] see paragraphs [0193.0.0.0] to [0196.0.0.0] above.

Homologues of the nucleic acid sequences used, with the sequence shown in table I, application no. 14, columns 5 and 7, preferably shown in table IB, application no. 14, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 14, columns 5 and 7, preferably shown in table IB, application no. 14, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 14, columns 5 and 7, preferably shown in table IB, application no. 14, columns 5 and 7. It is preferred that the nucleic acid molecule comprises as little as possible other nucleotides not shown in any one of table I, application no. 14, columns 5 and 7, preferably shown in table IB, application no. 14, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 14, columns 5 and 7, preferably shown in table IB, application no. 14, columns 5 and 7.

Also preferred is that the nucleic acid molecule used in the process of the invention encodes a polypeptide comprising the sequence shown in table II, application no. 14, columns 5 and 7, preferably shown in table IIB, application no. 14, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 14, columns 5 and 7, preferably shown in table IIB, application no. 14, columns 5 and 7.

In one embodiment, the nucleic acid molecule of the invention or used in the process encodes a polypeptide comprising the sequence shown in table II, application no. 14, columns 5 and 7, preferably shown in table IIB, application no. 14, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 14, columns 5 and 7, preferably shown in table IB, application no. 14, columns 5 and 7.

Polypeptides (=proteins), which still have the essential biological or enzymatic activity of the polypeptide of the present invention conferring an increase of the respective fine chemical indicated in column 6 of Table I, application no. 14, i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 14, columns 5 and 7 expressed under identical conditions.

Homologues of table I, application no. 14, columns 5 and 7 or of the derived sequences of table II, application no. 14, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.13] to [0215.0.0.13] see paragraphs [0203.0.0.0] to [0215.0.0.0] above.

Accordingly, in one embodiment, the invention relates to a nucleic acid molecule, which comprises a nucleic acid molecule selected from the group consisting of:
a) nucleic acid molecule encoding, preferably at least the mature form, of the polypeptide shown in table II, application no. 14, columns 5 and 7, preferably in table IIB, application no. 14, columns 5 and 7; or a fragment thereof conferring an increase in the amount of the fine chemical according to table IIB, application no. 14, column 6 in an organism or a part thereof
b) nucleic acid molecule comprising, preferably at least the mature form, of the nucleic acid molecule shown in table I, application no. 14, columns 5 and 7, preferably in table IB, application no. 14, columns 5 and 7 or a fragment thereof conferring an increase in the amount of the fine chemical according to table IIB, application no. 14, column 6 in an organism or a part thereof;
c) nucleic acid molecule whose sequence can be deduced from a polypeptide sequence encoded by a nucleic acid molecule of (a) or (b) as result of the degeneracy of the genetic code and conferring an increase in the amount of the fine chemical according to table IIB, application no. 14, column 6 in an organism or a part thereof;
d) nucleic acid molecule encoding a polypeptide whose sequence has at least 50% identity with the amino acid sequence of the polypeptide encoded by the nucleic acid molecule of (a) to (c) and conferring an increase in the amount of the fine chemical according to table IIB, application no. 14, column 6 in an organism or a part thereof;
e) nucleic acid molecule which hybridizes with a nucleic acid molecule of (a) to (c) under stringent hybridisation conditions and conferring an increase in the amount of the fine chemical according to table IIB, application no. 14, column 6 in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical according to table IIB, application no. 14, column 6 in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical according to table IIB, application no. 14, column 6 in an organism or a part thereof;
h) nucleic acid molecule comprising a nucleic acid molecule which is obtained by amplifying a cDNA library or a genomic library using the primers in table III, application no. 14, column 7 and conferring an increase in the amount of the fine chemical according to table IIB, application no. 14, column 6 in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising the consensus sequence shown in table IV, application no. 14, column 7 and conferring an increase in the amount of the fine chemical in an organism or a part thereof;
k) nucleic acid molecule encoding the amino acid sequence of a polypeptide encoding a domaine of the polypeptide shown in table II, application no. 14, columns 5 and 7 and conferring an increase in the amount of the fine chemical according to table IIB, application no. 14, column 6 in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 14, columns 5 and 7 or a nucleic acid molecule encoding, preferably at least the mature form of, the polypeptide shown in table II, application no. 14, columns 5 and 7, and conferring an increase in the amount of the fine chemical according to table IIB, application no. 14, column 6 in an organism or a part thereof; or which encompasses a sequence which is complementary thereto;
whereby, preferably, the nucleic acid molecule according to (a) to (l) distinguishes over the sequence depicted in table IA and/or IB, application no. 14, columns 5 and 7 by one or more nucleotides. In one embodiment, the nucleic acid molecule of the invention does not consist of the sequence shown in table IA and/or IB, application no. 14, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 14, columns 5 and 7. In a further embodiment the nucleic acid molecule does not encode the polypeptide sequence shown in table IIA and/or IIB, application no. 14, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 14, columns 5 and 7 does not encode a protein of the sequence shown in table IIA and/or IIB, application no. 14, columns 5 and 7. Accordingly, in one embodiment, the protein encoded by a sequence of a nucleic acid according to (a) to (l) does not consist of the sequence shown in table IA and/or IB, application no. 14, columns 5 and 7. In a further embodiment, the protein of the present invention is at least 30% identical to protein sequence depicted in table IIA and/or IIB, application no. 14, columns 5 and 7 and less than 100%, preferably less than 99.999%, 99.99% or 99.9%, more preferably less than 99%, 985, 97%, 96% or 95% identical to the sequence shown in table IIA and/or IIB, application no. 14, columns 5 and 7.

For the disclosure of the paragraphs [0217.0.0.13] to [0226.0.0.13] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 14, columns 5 and 7 can be cloned 3'prime to the transitpeptide encoding sequence, leading to a functional preprotein, which is directed to the plastids and which means that the mature protein fulfills its biological activity.

For the disclosure of the paragraphs [0228.0.0.13] to [0239.0.0.13] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 14, columns 5 and 7 or its derivatives, it is advantageous additionally to express and/or mutate further genes in the organisms. It can be especially advantageously, if additionally at least one further gene of the amino acid of the invention biosynthetic pathway, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the sequences shown in Table I, application no. 14, columns 5 and 7 with genes which generally support or enhances the growth or yield of the target organism, for example genes which lead to faster growth rate of microorganisms or genes which produces stress-, pathogen, or herbicide resistant plants.

In addition, it might be also advantageously to combine one or more of the sequences indicated in Table I, columns 5 or 7, application no. 14, with genes which modify plant architecture or flower development, in the way, that the plant either produces more flowers, or produces flowers with more petals in order to increase the respective fine chemical production capacity.

For the disclosure of the paragraphs [0241.0.0.13] to [0264.0.0.13] see paragraphs [0241.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 14, columns 5 and 7 and described herein to achieve an expression in one of said compartments or extracellular.

For the disclosure of the paragraphs [0266.0.0.13] to [0287.0.0.13] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 14, columns 5 and 7 or their homologs is functionally linked to a plastidial targeting sequence. A further preferred embodiment of the invention relates to a vector in which a nucleic acid sequence encoding one of the polypeptides shown in table II, application no. 14, columns 5 and 7 or their homologs is functionally linked to a regulatory sequences which permit the expression in plastids.

For the disclosure of the paragraphs [0289.0.0.13] to [0296.0.0.13] see paragraphs [0289.0.0.0] to [0296.0.0.0] above.

Moreover, a native polypeptide conferring the increase of the respective fine chemical in an organism or part thereof can be isolated from cells (e.g., endothelial cells), for example using the antibody of the present invention as described herein, in particular, an antibody against polypeptides as shown in table II, application no. 14, columns 5 and 7, which can be produced by standard techniques utilizing the polypeptid of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 14, columns 5 and 7 or as coded by the nucleic acid molecule shown in table I, application no. 14, columns 5 and 7 or functional homologues thereof.

In one advantageous embodiment, in the method of the present invention the activity of a polypeptide is increased comprising or consisting of the consensus sequence shown in table IV, application no. 14, columns 7 and in one another embodiment, the present invention relates to a polypeptide comprising or consisting of the consensus sequence shown in table IV, application no. 14, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

For the disclosure of the paragraphs [0301.0.0.13] to [0304.0.0.13] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 14, columns 5 and 7 by one or more amino acids. In one embodiment, polypeptide distinguishes form the sequence shown in table IIA and/or IIB, application no. 14, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 14, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 14, columns 5 and 7.

For the disclosure of this paragraph see paragraph [0306.0.0.0] above.

In one embodiment, the invention relates to polypeptide conferring an increase of level of the respective fine chemical indicated in Table IIA and/or IIB, application no. 14, column 6 in an organism or part being encoded by the nucleic acid molecule of the invention or used in the process of the invention and having a sequence which distinguishes from the sequence as shown in table IIA and/or IIB, application no. 14, columns 5 and 7 by one or more amino acids. In another embodiment, said polypeptide of the invention does not consist of the sequence shown in table IIA and/or IIB, application no. 14, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 14, columns 5 and 7.

In one embodiment, the present invention relates to a polypeptide having the activity of the protein as shown in table IIA and/or IIB, application no. 14, column 3, which distinguishes over the sequence depicted in table IIA and/or IIB, application no. 14, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle, for example into the plastid or mitochondria.

For the disclosure of the paragraphs [0309.0.0.13] to [0311.0.0.13] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 14, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 14, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 14, columns 5 and 7 or which is homologous thereto, as defined above.

Accordingly the polypeptide of the present invention can vary from the sequences shown in table IIA and/or IIB, application no. 14, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 14, columns 5 and 7.

For the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 14, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 14, column 3. Differences shall mean at least one amino acid different from the sequences as shown in table II, application no. 14, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 14, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 14, column 3. The nucleic acid molecules and polypeptide molecules of the invention are expressed such that the yield, production, and/or efficiency of production of a desired compound is improved.

Preferably, the compound is a composition comprising the essentially pure fine chemical, i.e. amino acid of the invention, e.g. 5-oxoproline, alanine, aspartic acid (aspartate), citrulline, glycine, homoserine, phenylalanine, serine and/or tyrosine or a recovered or isolated amino acid of the invention in free or in protein- or membrane-bound form.

For the disclosure of the paragraphs [0320.0.0.13] to [0322.0.0.13] see paragraphs [0320.0.0.0] to [0322.0.0.0] above.

In one embodiment, a protein (=polypeptide) as shown in table II, application no. 14, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 14, column 3, e.g., a protein which does not confer the activity described herein and which is derived from the same or a different organism.

For the disclosure of the paragraphs [0324.0.0.13] to [0329.0.0.13] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 14, columns 5 and 7.

For the disclosure of the paragraphs [0331.0.0.13] to [0346.0.0.13] see paragraphs [0331.0.0.0] to [0346.0.0.0] above.

Accordingly the present invention relates to any cell transgenic for any nucleic acid characterized as part of the invention, e.g. conferring the increase of the respective fine chemical indicated in column 6 of application no. 14 in any one of Talbes I to IV in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 14, column 3. Due to the above mentioned activity the respective fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 14, column 3 or a protein as shown in table II, application no. 14, column 3-like activity is increased in the cell or organism or part thereof especially in organelles such as plastids or mitochondria. Examples are described above in context with the process of the invention.

For the disclosure of this paragraph see paragraph [0348.0.0.0] above.

A naturally occurring expression cassette—for example the naturally occurring combination of the promoter of the gene encoding a protein as shown in table II, application no. 14, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.13] to [0369.0.0.13] see paragraphs [0350.0.0.0] to [0369.0.0.0] above.

The fermentation broths obtained in this way, containing in particular the respective fine chemical indicated in column 6 of any one of Tables I to IV; application no. 14 or containing mixtures with other compounds, in particular with other amino acids, vitamins or fatty acids or containing microorganisms or parts of microorganisms, like plastids, normally have a dry matter content of from 7.5 to 25% by weight. The fermentation broth can be processed further. Depending on requirements, the biomass can be separated, such as, for example, by centrifugation, filtration, decantation, coagulation/flocculation or a combination of these methods, from the fermentation broth or left completely in it. The fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction, freeze-drying, spray drying, spray granulation or by other processes.

for the disclosure of the paragraphs [0371.0.0.13] to [0376.0.0.13], [0376.1.0.13] and [0377.0.0.13] see paragraphs [0371.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 14, columns 5 and 7, preferably in table IB, application no. 14, columns 5 and 7, and, optionally, isolating the full length cDNA clone or complete genomic clone;

(c) introducing the candidate nucleic acid molecules in host cells, preferably in a plant cell or a microorganism, appropriate for producing the respective fine chemical;

(d) expressing the identified nucleic acid molecules in the host cells;

(e) assaying the respective fine chemical level in the host cells; and (f) identifying the nucleic acid molecule and its gene product which expression confers an increase in the respective fine chemical as indicated for application no. 14 in any one of Tables I to IV level in the host cell after expression compared to the wild type.

for the disclosure of the paragraphs [0379.0.0.13] to [0383.0.0.13] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 14, column 3, e.g. comparing near identical organisms with low and high activity of the proteins as shown in table II, application no. 14, column 3.

for the disclosure of the paragraphs [0385.0.0.13] to [0416.0.0.13] see paragraphs [0385.0.0.0] to [0416.0.0.0] above.

An in vivo mutagenesis of organisms such as algae (e.g. *Spongiococcum* sp, e.g. *Spongiococcum exentricum*, *Chlorella* sp., *Haematococcus*, *Phaedactylum tricornatum*, *Volvox* or *Dunaliella*), *Synechocystis* sp. PCC 6803, *Physcometrella patens*, *Saccharomyces*, *Mortierella*, *Escherichia* and others mentioned above, which are beneficial for the production of amino acids of the invention can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widly used as chemical agents for random in-vitro mutagenesis. The most common physical method for mutagenesis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagensis kit protocol. A huge number of other methods are also known and used in common practice.

Positive mutation events can be selected by screening the organisms for the production of the desired fine chemical.

for the disclosure of the paragraphs [0418.0.0.13] to [0435.0.0.13] see paragraphs [0418.0.0.0] to [0435.0.0.0] above.

Production of Amino Acid of the Invention, Preferably 5-oxoproline, Alanine, Aspartic Acid (Aspartate), Citrulline, Glycine, Homoserine, Phenylalanine, Serine and/or Tyrosine The production of the amino acid of the invention can be analysed as mentioned above. The proteins and nucleic acids can be analysed as mentioned below.

for the disclosure of the paragraphs [0437.0.0.13] to [0497.0.0.13] see paragraphs [0437.0.0.0] to [0497.0.0.0] above.

The results of the different plant analyses can be seen from the table, which follows:

TABLE VI

| ORF | Metabolite | Method/Analytics | Min.-Value | Max.-Value |
|---|---|---|---|---|
| b0342 | Alanine | GC | 1.20 | 1.43 |
| b0403 | Phenylalanine | LC | 1.31 | 1.59 |
| b0628 | Homoserine | GC | 1.34 | 1.47 |
| b0754 | Phenylalanine | GC | 1.28 | 2.22 |
| b0760 | Tyrosine | GC | 1.22 | 1.37 |
| b1062 | Alanine | GC | 1.26 | 1.61 |
| b1062 | Citrulline | LC | 1.39 | 1.90 |
| b1062 | Glycine | GC | 1.51 | 1.96 |
| b1062 | Homoserine | GC | 1.26 | 2.11 |
| b1062 | Serine | GC | 1.23 | 1.48 |
| b1136 | Citrulline | LC | 1.32 | 1.60 |
| b1136 | Phenylalanine | GC | 1.35 | 2.47 |
| b1223 | Glycine | GC | 1.58 | 2.22 |
| b1223 | Phenylalanine | LC | 1.31 | 2.42 |
| b1264 | Alanine | GC | 1.21 | 1.55 |
| b1264 | Citrulline | LC | 1.38 | 1.63 |
| b1264 | Glycine | GC | 1.37 | 1.73 |
| b1264 | Homoserine | GC | 1.25 | 1.44 |
| b1264 | Serine | GC | 1.35 | 1.96 |
| b1556 | Aspartate | GC | 1.58 | 2.97 |
| b1611 | Serine | GC | 1.24 | 1.41 |
| b1640 | 5-Oxoproline | GC | 1.24 | 1.33 |
| b1640 | Aspartate | GC | 1.46 | 1.60 |
| b1704 | Phenylalanine | GC | 1.43 | 387.55 |

TABLE VI-continued

| ORF | Metabolite | Method/Analytics | Min.-Value | Max.-Value |
|---|---|---|---|---|
| b1704 | Tyrosine | GC | 11.14 | 104.59 |
| b1758 | Aspartate | GC | 1.51 | 2.09 |
| b1758 | Citrulline | LC | 1.40 | 1.96 |
| b1758 | Serine | GC | 1.24 | 1.47 |
| b2066 | Aspartate | GC | 1.48 | 2.33 |
| b2223 | Tyrosine | LC | 1.39 | 1.77 |
| b2312 | Aspartate | GC | 1.52 | 2.14 |
| b2366 | Citrulline | LC | 1.32 | 1.66 |
| b2366 | Glycine | GC | 1.43 | 1.98 |
| b2600 | Tyrosine | GC | 2.59 | 4.78 |
| b2601 | Phenylalanine | GC | 2.52 | 21.64 |
| b2601 | Tyrosine | GC | 2.32 | 16.67 |
| b2818 | Citrulline | LC | 2.81 | 4.28 |
| b2965 | Alanine | GC | 1.21 | 1.72 |
| b2965 | Glycine | GC | 1.52 | 2.98 |
| b2965 | Phenylalanine | LC | 1.31 | 3.04 |
| b2965 | Serine | GC | 1.33 | 2.93 |
| b3117 | Citrulline | LC | 1.43 | 2.66 |
| b3213 | Citrulline | LC | 1.32 | 1.56 |
| b3390 | Phenylalanine | LC | 3.41 | 3.41 |
| b3390 | Tyrosine | LC | 2.89 | 2.89 |
| b3429 | Serine | GC | 1.25 | 1.70 |
| b3616 | Homoserine | GC | 1.26 | 2.01 |
| b3616 | Serine | GC | 1.23 | 1.87 |
| b4053 | Alanine | GC | 1.35 | 2.29 |
| b4139 | Citrulline | LC | 2.45 | 6.22 |
| b4139 | Serine | GC | 2.30 | 5.78 |
| YAL038W | Alanine | GC | 1.27 | 2.70 |
| YAL038W | Phenylalanine | GC | 1.25 | 1.51 |
| YBL082C | Tyrosine | GC | 1.30 | 1.61 |
| YDR035W | Phenylalanine | GC | 1.40 | 23.44 |
| YDR035W | Tyrosine | LC | 1.43 | 6.09 |
| YDR430C | Phenylalanine | GC | 1.38 | 2.31 |
| YDR497C | Tyrosine | GC | 1.38 | 1.46 |
| YEL046C | Homoserine | GC | 1.26 | 2.17 |
| YKR043C | Phenylalanine | GC | 1.35 | 4.40 |
| YKR043C | Serine | GC | 1.26 | 1.60 |
| YLR174W | Tyrosine | GC | 1.20 | 1.25 |
| YNL241C | Alanine | GC | 1.66 | 2.15 |
| YNL241C | Tyrosine | GC | 1.29 | 1.35 |
| YNR012W | Aspartate | GC | 1.48 | 1.73 |
| YOR353C | Phenylalanine | GC | 1.41 | 2.06 | for the disclosure of the paragraphs [0499.0.0.13] to [0554.0.0.13] see paragraphs [0551.0.0.1] to [0554.0.0.1] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII as minimal (MIN) or maximal changes (MAX) in the respective fine chemical (column "metabolite") in genetically modified corn plants expressing the sequence listed in column 1 (ORF).

TABLE VII

| ORF | Metabolite | MIN | MAX |
|---|---|---|---|
| b0754 | Phenylalanine | 1.55 | 3.25 |
| b1704 | Phenylalanine | 3.07 | 18.75 |
| b1704 | Tyrosine | 1.83 | 5.36 |
| b2066 | Aspartic acid | 1.56 | 1.78 |
| b2601 | Phenylalanine | 1.47 | 10.95 |
| b2601 | Tyrosine | 1.75 | 7.71 |
| b2818 | Citrulline | 1.96 | 2.36 |
| b4053 | Alanine | 1.58 | 2.69 |
| b4139 | Citrulline | 1.61 | 2.92 |
| b4139 | Serine | 1.45 | 1.67 |
| YAL038W | Alanine | 1.96 | 6.28 |
| YAL038W | Phenylalanine | 1.61 | 5.39 |
| YBL082C | Tyrosine | 1.40 | 4.08 |
| YDR035W | Trosine | 1.63 | 6.29 |
| YDR035W | Phenylalanine | 7.07 | 20.09 |
| YDR497C | Tyrosine | 1.52 | 1.64 |
| YKR043C | Serine | 1.23 | 16.90 |
| YKR043C | Phenylalanine | 4.47 | 9.96 |
| YNL241C | Tyrosine | 1.37 | 2.27 |
| YNR012W | Aspartic acid | 2.03 | 6.97 |

In one embodiment, in case the activity of the protein listed in column 1 of Table VII or its homologs, is increased in corn plants, preferably, an increase of the respective fine chemical as indicated in column 2 (Metabolite) is in the range between the minimal value shown in the line "MIN" and the maximal value shown in the line "MAX is conferred.

for the disclosure of this paragraph see [0554.2.0.0] above.
for the disclosure of this paragraph see [0555.0.0.0] above.
for the disclosure of this paragraph see [0001.0.0.0].
for the disclosure of this paragraph see [0002.0.7.7] above.

Oils and fats, which chemically are glycerol esters of fatty acids (triacylglycerols (TAGs)), play a major role in nutrition but more and more in nonfood applications such as lubricants, hydraulic oil, biofuel, or oleochemicals for coatings, plasticizer, soaps, and detergents (W. Lohs and W. Friedt, in Designer Oil Crops, D. J. Murphy, Ed. (VCH, Weinheim, Germany, 1993)). The ideal oil for industrial application would consist of a particular type of fatty acid that could be supplied constantly at a competitively low price as compared with raw materials based on mineral oil products. Furthermore, such a fatty acid may have a reactive group in addition to the carboxyl function to provide an additional target for chemical modifications (Topfer et al., Science, Vol. 268, 681-686, 1995).

for the disclosure of the paragraph [0004.0.7.14] see paragraph [0004.0.7.7] above.

Further sources of fatty acids are membrane lipids of organisms. Preferably lipids are phopholipids and/or glycolipids, more preferably glycerophospholipids, galactolipids and/or sphingolipids.

Margaric acid was first mentioned in the early 1800s. 1813 M. E. Chevreul discovered that fats are composed of fatty acids and named one of these "margaric acid" because it glistened with lustrous pearly drops that reminded him of the Greek word for pearl, margaron or margarites. In the middle of the 1800s W. H. Heintz showed that "margaric acid" discovered by Chevreul was an indefinite mixture of palmitic and stearic acids.

Today, the term "margaric acid" is the trivial name for heptadecanoic acid (17:0), which is naturally occurring in minor amounts.

The fatty acid with odd number of carbon atoms is present in trace amounts in plants, in triglycerides from Brazil-nut oil, Dracocephalum moldavica oil, Poppy-seed, Palm, Almond, Sunflower or Soyabean. Margaric acid can be isolated from tallow (1%), specially from subcutaneous adipose tissue in subcutaneous fat from lambs.

Margaric acid can be ingredient of satiety agents or fungicide composition. It is further used as ingredient in cosmetics, pharmaceuticals and in feed and food, like baking adjuvants as disclosed in US 20030143312 or accordind to US 20040097392 as component in surfactant systems.

The heptadecanoic acid is mainly used as an internal standard in quantification of fatty acids. It can be further useful in treatment of neurological diseases which may be caused by yeast, fungi or prions based on yeast or fungal etiology (U.S. Pat. No. 6,652,866) or in antikeratolytic-wound healing compositions (U.S. Pat. No. 5,641,814). Heptadecanoic acid was produced up to now in higher amount primarily by organic synthesis.

2-Hydroxy fatty acids are synthesised in animal and plant tissues, and are often major constituents of the sphingolipids. Sphingolipids with 2-hydroxy fatty acid are found in most organisms including plants, yeast, worms, vertebrate animals, and some bacterial species.

In plants more than 95% of the fatty acid component of the ceramides and sphingolipids is alpha-hydroxylated. The acyl groups of ceramides tend to consist of long-chain (C16 up to C26 but occasionally longer) odd- and even-numbered saturated or monoenoic fatty acids and related 2-D-hydroxy fatty acids, both in plant and animal tissues. Typical plant sphingolipids are made up by the long-chain sphingosine backbone which is glycosylated and amide-linked to an usually hydroxylated (very-)-long-chain fatty acid, called cerebroside. Cerebrosides are essential constituents of the plasma membrane involved in various physiological functions including signaling, exocytosis, anchoring of proteins, and vesicular protein transport (Matthes et al., Z. Naturforsch. 57C, 843-852, 2002).

In mammals, 2-hydroxysphingolipids are present abundantly in brain because the major myelin lipids galactosylceramides and sulfatides contain 2-hydroxy fatty acids. In mammals, 2-hydroxy fatty acid-containing sphingolipids are uniquely abundant in nervous and epidermal tissues. In mammalian central and peripheral nervous systems, galactosylceramides and sulfatides (3-sulfate ester of galactosylceramide) are major lipid components of myelin. These glycosphingolipids contain a high proportion (about 50%) of 2-hydroxy fatty acid and are critical components of myelin (4, 5).

In the yeast Saccharomyces cerevisiae most sphingolipids contain 2-hydroxy fatty acid. COS7 cells expressing human FA2H contained 3-20-fold higher levels of 2-hydroxyceramides (C16, C18, C24, and C24:1) and 2-hydroxy fatty acids compared with control cells (Alderson et al., J. Biol. Chem. Vol. 279, No. 47, 48562-48568, 2004).

The 2-hydroxylation occurs during de novo ceramide synthesis and is catalyzed by fatty acid 2-hydroxylase (also known as fatty acid alpha-hydroxylase). No free hydroxy fatty acid or hydroxy fatty acid CoA has ever been reported; the hydroxylated product always appeared as a component of ceramide or cerebroside (Hoshi et al., J. Biol. Chem. 248, 4123-4130, 1973). The alpha-hydroxylation involves the direct hydroxylation of a sphingolipid-bound fatty acid. (Kayal et al., J. Biol. Chem. Vol. 259, No. 6, 3548-3553, 1984).

Hydroxylated fatty acids initiate inflammation in the soft tissues and regulate the immune response.

The 2-hydroxyl group in sphingolipids has a profound effect in the lipid organization within membranes because of its hydrogenbonding capability.

Alpha-hydroxy-palmitic acid (hC 16:0) is mainly a building block of plant sphingolipids, for example soy glucosylceramide (GlcCer), which consists predominantly of a 4,8-sphingadiene backbone and alpha-hydroxy-palmitic acid. Soy GlcCer suppress tumorigenesis and gene expression in mice (Symolon et al., J. Nutr. 2004 May; 134(5):1157-61).

A monoglucosecerebroside (pinelloside) with strong anti-microbial properties (against Gram-positive and -negative bacteria and against fungi) was described in the tuber of Pinella ternata (Araceae), one component of decoctions used in traditional Chinese medicine (Chen et al., Phytochemistry 2003, 64, 903). Its structure was shown to include a glucose moiety and the unusual 4,11-sphingadienine linked to a 2-hydroxypalmitic acid.

Another hydroxylated fatty acid being a building block of cerrebrosides is the 2-hydroxy-nervonic acid (2-OH—C24: 1). 2-hydroxy-15-tetracosenoic acid (hydroxynervonic acid) is constituent of the ceramide part of cerebrosides (glycosphingolipides found mainly in nervous tissue and in little amount in plants). The occurrence of 2-hydroxy nervonic acid is characteristic for the leaf cerebrosides of some chilling-resistant cereals (Sperling et al., BBA 1632, 1-15, 2003).

The hydroxylated fatty acid may be used in a method for producing fats or oils according to US 20030054509 or in lanolin-free cosmetic composition according to US 20040166130.

Monounsaturated fatty acids most frequently occur in higher concentrations in plant foods such as olive oil, most nuts, and avocados. When contrasted to saturated fatty acids, dietary monounsaturated fatty acids are healthful because they lower blood cholesterol concentrations, specially they help lower LDL-cholesterol when they are substituted for foods high in saturated fat.

Oleic acid, a nonessential fatty acid with one double bond is the most common dietary monounsaturated, it is the major fatty acid in olive oil and canola oil.

There is evidence that oleic acid, found in the olive oil or carp oil, may have a important role in treating cancer, due to its antitumor and antimetastatic effects (Annals of Oncology. 2005 and Kimura et al., J. Nutr. 132:2069-2075, 2002).

Oleic acid is also used to reduce the population of the bacterial flora of poultry skin as reported by Hinton et al., J Food Prot. 2000 September; 63(9):1282-6. His findings indicate that oleic acid reduces the number of bacteria on the skin of processed broilers and that the fatty acid is bactericidal to several spoilage and pathogenic bacteria associated with poultry.

Oleic acid may be also used in making soap and cosmetics and ointments and lubricating oils or electrical insulation fluids (U.S. Pat. No. 6,645,404).

Further monounsaturated fatty acids are prevalent in most diets because of the widespread use of hydrogenated oils by manufacturers of margarine, bakery products, and peanut butters. One of them is headecenoic acid. Specially the 9-hexadecenoic acid is to be found in the two isoforms cis and trans, also known as palmitoleic and palmitelaidic acid respectively. Okuyama et al. report high level of a 9-trans-hexadecenoic acid (C 16:1 9t) found in the phospholipids of a psychrophilic bacterium, Vibrio sp. strain ABE-1 cultivated at 20° C. (Journal of Bacteriology 172(6) 3515-3518). The same author further reports the cis/trans isomerization of the double bond the fatty acid (Biochim Biophys Acta. 1991 Jun. 19; 1084(1):13-20). The isomerase which catalyzes the cis-trans conversion of the abundant unsaturated membrane fatty acids 9-cis-hexadecenoic acid in Pseudomonas oleovorans was identified by Pedrotta et al. (J Bacteriol. 1999 May; 181(10): 3256-3261).A Whether oils with unsaturated or with saturated fatty acids are preferred depends on the intended purpose; thus, for example, lipids with unsaturated fatty acids, specifically polyunsaturated fatty acids, are preferred in human nutrition since they have a positive effect on the cholesterol level in the blood and thus on the possibility of heart disease. They are used in a variety of dietetic foodstuffs or medicaments. In addition PUFAs are commonly used in food, feed and in the cosmetic industry. Poly unsaturated ω-3- and/or ω-6-fatty acids are an important part of animal feed and human food. Because of the common composition of human food polyunsaturated ω-3-fatty acids, which are an essential component of fish oil, should be added to the food to increase the nutritional value of the food; thus, for example, polyunsaturated fatty acids such as DHA or EPA are added as mentioned above to infant formula to increase its nutritional value. The true essential fatty acids linoleic and linolenic fatty acid have a lot of positive effects in the human body such as a positive effect on healthy heart, arteries and skin. They bring for example relieve from eczema, diabetic neuropathy or PMS and cyclical breast pain.

Further poly unsaturated ω-3- and/or ω-6-fatty acids important part of animal feed and human food are delta 7, 10 hexadecadienic acid (16:2(n-6)) and delta 7, 10, 13 hexadecatrienic acid (16:3(n-3)).

Hexadecadienic acid is a minor component of some seed and fish oils, and of plant leaves but the precursor of hexadecatrienic acid 16:3(n-3), which is a common constituent of leaf lipids. This acid is known to occur in photosynthetic leaves, such as for example *Arabidopsis thaliana*, rape leaves, fem lipid, ginko leaves, potato leaves, tomato leaves and spinach. It may also occur in the leaves of Brassicaceae plants, such as horse radish, cabbage, turnip, Chinese mustard, cauliflower and watercress.

In higher plants, the galactolipids contain a high proportion of polyunsaturated fatty acids, up to 95% of which can be linolenic acid (18:3(n-3)). In this instance, the most abundant molecular species of mono- and digalactosyldiacylglycerols must have 18:3 at both sn-1 and sn-2 positions of the glycerol backbone. Plants such as the pea, which have 18:3 as almost the only fatty acid in the monogalactosyldiacylglycerols, have been termed "18:3 plants". Other species, and *Arabidopsis thaliana* is an example, contain appreciable amounts of hexadecatrienoic acid (16:3(n-3)) in the monogalactosyldiacylglycerols, and they are termed "16:3 plants".

As mentioned, polyunsaturated fatty acid are further used in the cosmetic industry. The application US 20030039672 discloses a cosmetic method for treating aged, sensitive, dry, flaky, wrinkled and/or photodamaged skin through topical application of a composition which comprises an unsaturated C16 fatty acid having at least three double bonds, which may be preferably hexadecatrienoic acid.

for the disclosure of this paragraph see [0009.0.7.7] above.
for the disclosure of this paragraph see [0010.0.7.7] above.
for the disclosure of this paragraph see [0011.0.7.7] above.
for the disclosure of this paragraph see [0012.0.7.7] above.
for the disclosure of this paragraph see [0013.0.0.0] above.

Accordingly, in a first embodiment, in context of paragraphs [0001.n.n.14] to [0555.n.n.14] the invention relates to a process for the production of a fine chemical, whereby the fine chemical is hexadecenoic acid, preferably 9-hexadecenoic acid, more preferably trans-9-hexadecenoic acid ((E)-9-Hexadecenoic acid; palmitelaidic acid; trans-9-hexadecenoic acid; trans-palmitoleic acid, CAS Registry No.:10030-73-6) and/or 2-hydroxy palmitic acid (2-OH—C16:0, alfa-hydroxy palmitic acid, C16:0 OH) and/or heptadecanoic acid (C17:0, margaric acid) and/or 2-hydroxy-tetracosenoic-acid, preferably 2-hydroxy-15-tetracosenoic acid (hydroxynervonic acid, alfa-hydroxy-tetracosenoic-acid, C24:1 (n-9) OH, 2-hydroxy-cis 9tetracosenoic-acid, delta 9 hydroxy-tetracosenoic-acid) and/or hexadecadienoic acid, preferably delta 7,10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid (9-Octadecenoic acid, (Z)-; oleic acid) and/or hexadecatrienoic acid, preferably delta 7, 10, 13 hexadecatrienoic acid (C16:3 (n-3), cis 7-cis 10-cis 13-hexadecatrienoic acid, hiragonic acid)

or triglycerides, lipids, oils or fats containing hexadecenoic acid, preferably 9-hexadecenoic acid, more preferably trans-9-hexadecenoic acid ((E)-9-Hexadecenoic acid; palmitelaidic acid; trans-9-hexadecenoic acid; trans-palmitoleic acid, CAS Registry No.:10030-73-6) and/or 2-hydroxy palmitic acid (2-OH-C16:0, alfa-hydroxy palmitic acid, C16:0 OH) and/or heptadecanoic acid (C17:0, margaric acid) and/or 2-hydroxy-tetracosenoic-acid, preferably 2-hydroxy-15-tetracosenoic acid (hydroxynervonic acid, alfa-hydroxy-tetracosenoic-acid, C24:1 (n-9) OH, 2-hydroxy-cis 9-tetracosenoic-acid, delta 9 hydroxy-tetracosenoic-acid) and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid (9-Octadecenoic acid, (Z)-; oleic acid) and/or hexadecatrienoic acid, preferably delta 7,10,13 hexadecatrienoic acid (C16:3 (n-3), cis 7-cis 10-cis 13-hexadecatrienoic acid, hiragonic acid).

Accordingly, in the present invention of paragraphs [0001.n.n.14] to [0555.n.n.14], the term "the fine chemical" as used herein relates to "hexadecenoic acid", preferably "9-hexadecenoic acid", more preferably "trans-9-hexadecenoic acid" and/or
"2-hydroxy palmitic acid" and/or
"heptadecanoic acid" and/or
"2-hydroxy-tetracosenoic-acid", preferably "2-hydroxy-15-tetracosenoic acid" and/or
"hexadecadienoic acid", preferably "delta 7, 10 hexadecadienoic acid" and/or
"octadecenoic acid", preferably "9-Octadecenoic acid", more preferably "(Z)-9-octadecenoic acid" and/or
"hexadecatrienoic acid, preferably delta 7,10,13 hexadecatrienoic acid" or "triglycerides, lipids, oils or fats containing hexadecenoic acid, preferably 9-hexadecenoic acid, more preferably trans-9-hexadecenoic acid and/or
2-hydroxy palmitic acid and/or
heptadecanoic acid and/or
2-hydroxy-tetracosenoic-acid, preferably 2-hydroxy-15-tetracosenoic acid and/or
hexadecadienoic acid, preferably delta 7,10 hexadecadienoic acid (C16:2 (n-6), cis 7-cis 10-hexadecadienoic acid) and/or
octadecenoic acid, preferably 9-Octadecenoic acid, more preferably (Z)-9-octadecenoic acid and/or
hexadecatrienoic acid, preferably delta 7, 10, 13 hexadecatrienoic acid". Further, the term "the fine chemicals" as used herein also relates to fine chemicals comprising hexadecenoic acid, preferably 9-hexadecenoic acid, more preferably trans-9-hexadecenoic acid and/or
2-hydroxy palmitic acid and/or
heptadecanoic acid and/or
2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid.

In one embodiment, the term "the fine chemical" or "the respective fine chemical" means hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7,10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid. Throughout the specification of paragraphs [0001.n.n.14] to [0555.n.n.14] the term "the fine chemical" of paragraphs [0001.n.n.14] to [0555.n.n.14] or "the respective fine chemical" of paragraphs [0001.n.n.14] to [0555.n.n.14] means hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acidin free form or bound to other compounds such as triglycerides, glycolipids, phospholipids etc. In a preferred embodiment, the term "the fine chemical" of paragraphs [0001.n.n.14] to [0555.n.n.14] means hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, in free form or its salts or bound to triglycerides. Triglycerides, lipids, oils, fats or lipid mixture thereof shall mean any triglyceride, lipid, oil and/or fat containing any bound or free hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid for example sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, or as monoacylglyceride, diacylglyceride or triacylglyceride or other fatty acid esters such as acetyl-Coenzym A thioester, which contain further saturated or unsaturated fatty acids in the fatty acid molecule.

In one embodiment, the term "the fine chemical" and the term "the respective fine chemical" mean at least one chemical compound with an activity of the above-mentioned fine chemical.

Accordingly, the present invention relates to a process for the production of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, which comprises (a) increasing or generating the activity of a protein as shown in table II, application no. 15, column 3 encoded by the nucleic acid sequences as shown in table I, application no. 15, column 5, in an organelle of a microorganism or plant, or (b) increasing or generating the activity of a protein as shown in table II, application no. 15, column 3 encoded by the nucleic acid sequences as shown in table I, application no. 15, column 5 in the plastid of a microorganism or plant, or in one or more parts thereof; and (b) growing the organism under conditions which permit the production of the fine chemical, thus, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or fine chemicals comprising hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, in said organism or in the culture medium surrounding the organism.

Accordingly, the term "the fine chemical" means in one embodiment "hexadecenoic acid, preferably 9-hexadecenoic acid, more preferably trans-9-hexadecenoic acid" in relation to all sequences listed in Table I to IV, lines 182 to 183 or homologs thereof;

and means in one embodiment "2-hydroxy palmitic acid" in relation to all sequences listed in Tables I to IV, lines 184 to 189 or homologs thereof;

and means in one embodiment "heptadecanoic acid" in relation to all sequences listed in Tables I to IV, line 190 or homologs thereof;

and means in one embodiment "2-hydroxy-tetracosenoic-acid" in relation to all sequences listed in Table I, lines 191 to 202, or homologs thereof;

and means in one embodiment "hexadecadienoic acid" in relation to all sequences listed in Table I to IV, lines 203 to 206 or homologs thereof;

and means in one embodiment "octadecenoic acid, preferably 9-Octadecenoic acid, more preferably (Z)-9-octadecenoic acid" in relation to all sequences listed in Table I, lines 207, or homologs thereof;

and means in one embodiment "hexadecatrienoic acid, preferably delta 7, 10, 13 hexadecatrienoic acid" in relation to all sequences listed in Table I to IV, lines 208 to 210 or homologs thereof.

Accordingly, in one embodiment the term "the fine chemical" means "hexadecenoic acid, preferably 9-hexadecenoic acid, more preferably trans-9-hexadecenoic acid" and "2-hydroxy-tetracosenoic-acid, preferably 2-hydroxy-15-tetracosenoic acid" in relation to all sequences listed in Table I to IV, lines 183 and 201. In one embodiment the term "the fine chemical" means "2-hydroxy palmitic acid" and "2-hydroxy-tetracosenoic-acid, preferably 2-hydroxy-15-tetracosenoic acid" in relation to all sequences listed in Table I to IV, lines 185 and 194. In one embodiment the term "the fine chemical" means "2-hydroxy palmitic acid" and "oleic acid" in relation to all sequences listed in Table I to IV, lines 187 and 207. In one embodiment the term "the fine chemical" means any combination of two or all three fine chemicals selected from the group consisting of "2-hydroxy palmitic acid" and "hexadecadienoic acid, preferably delta 7, 10 hexadecadienoic acid" and/or "hexadecatrienoic acid, preferably delta 7, 10, 13 hexadecatrienoic acid" in relation to all sequences listed in Table I to IV, lines 189, 204 and 209. In one embodiment the term "the fine chemical" means "hexadecadienoic acid, preferably delta 7, 10 hexadecadienoic acid" and/or "hexadecatrienoic acid, preferably delta 7, 10, 13 hexadecatrienoic acid" in relation to all sequences listed in Table I to IV, lines 203 and 208. In one embodiment the term "the fine chemical" means "hexadecadienoic acid, preferably delta 7, 10 hexadecadienoic acid" and/or "hexadecatrienoic acid, preferably delta 7, 10, 13 hexadecatrienoic acid" in relation to all sequences listed in Table I to IV, lines 206 and 210.

Accordingly, the term "the fine chemical" can mean "hexadecenoic acid", preferably "9-hexadecenoic acid", more preferably "trans-9-hexadecenoic acid" and/or "2-hydroxy palmitic acid" and/or "heptadecanoic acid" and/or "2-hydroxy-tetracosenoic-acid", preferably "2-hydroxy-15-tetracosenoic acid" and/or "hexadecadienoic acid", preferably "delta 7, 10 hexadecadienoic acid" and/or "octadecenoic acid", preferably "9-Octadecenoic acid", more preferably "(Z)-9-octadecenoic acid" and/or "hexadecatrienoic acid, preferably delta 7, 10, 13 hexadecatrienoic acid", owing to circumstances and the context. In order to illustrate that the meaning of the term "the fine chemical" means "hexadecenoic acid", preferably "9-hexadecenoic acid", more preferably "trans-9-hexadecenoic acid" and/or "2-hydroxy palmitic acid" and/or "heptadecanoic acid" and/or "2-hydroxy-tetracosenoic-acid", preferably "2-hydroxy-15-tetracosenoic acid" and/or "hexadecadienoic acid", preferably "delta 7, 10 hexadecadienoic acid" and/or "octadecenoic acid", preferably "9-Octadecenoic acid", more preferably "(Z)-9-octadecenoic acid" and/or "hexadecatrienoic acid, preferably delta 7, 10, 13 hexadecatrienoic acid" the term "the respective fine chemical" is also used.

In another embodiment the present invention is related to a process for the production of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, which comprises (a) increasing or generating the activity of a protein as shown in table II, application no. 15, column 3 encoded by the nucleic acid sequences as shown in table I, application no. 15, column 5, in an organelle of a non-human organism, or (b) increasing or generating the activity of a protein as shown in table II, application no. 15, column 3 encoded by the nucleic acid sequences as shown in table I, application no. 15, column 5, which are joined to a nucleic acid sequence encoding a transit peptide in a non-human organism, or in one or more parts thereof; or (c) increasing or generating the activity of a protein as shown in table II, application no. 15, column 3 encoded by the nucleic acid sequences as shown in table I, application no. 15, column 5, which are joined to a nucleic acid sequence encoding chloroplast localization sequence, in a non-human organism, or in one or more parts thereof, and (d) growing the organism under conditions which permit the production of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid in said organism.

In another embodiment, the present invention relates to a process for the production of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, which comprises (a) increasing or generating the activity of a protein as shown in table II, application no. 15, column 3 encoded by the nucleic acid sequences as shown in table I, application no. 15, column 5, in an organelle of a microorganism or plant through the transformation of the organelle, or (b) increasing or generating the activity of a protein as shown in table II, application no. 15, column 3 encoded by the nucleic acid sequences as shown in table I, application no. 15, column 5 in the plastid of a microorganism or plant, or in one or more parts thereof through the transformation of the plastids; and (c) growing the organism under conditions which permit the production of the fine chemical, thus, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or fine chemicals comprising hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, in said organism or in the culture medium surrounding the organism.

Advantagously the activity of the protein as shown in table II, application no. 15, column 3 encoded by the nucleic acid sequences as shown in table I, application no. 15, column 5 is increased or generated in the abovementioned process in the plastid of a microorganism or plant.

for the disclosure of the paragraphs [0019.0.0.14] to [0024.0.0.14] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991:104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 15, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 15, column 3 and its homologs as disclosed in table I, application no. 15, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 15, column 3 and its homologs as disclosed in table I, application no. 15, columns 5 and 7.

for the disclosure of the paragraphs [0027.0.0.14] to [0029.0.0.14] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 15, columns 5 and 7. The person skilled in the art is able to join said sequences in a functional manner. Advantageously the transit peptide part is cleaved off from the protein part shown in table II, application no. 15, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 15, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 15, columns 5 and 7. In case of the amino acid sequence QIA CSS the three amino acids in front of the start methionine are stemming from the LIC (=ligation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 15, columns 5 and 7. Furthermore the skilled worker is aware of the fact that there is not a need for such short sequences in the expression of the genes.

Table V: Examples of transit peptides disclosed by von Heijne et al.: for the disclosure of the Table V see paragraphs [0030.2.0.0] above.

Alternatively to the targeting of the sequences shown in table II, application no. 15, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 15, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.14] and [0030.3.0.14] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 15, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 15, columns 5 and 7 or a sequence encoding a protein, as depicted in table II, application no. 15, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 15, columns 5 and 7 or a sequence encoding a protein, as depicted in table II, application no. 15, columns 5 and 7 in such a manner that the viroid sequence transports a sequence transcribed from a sequence as depicted in table I, application no. 15, columns 5 and 7 or a sequence encoding a protein as depicted in table II, application no. 15, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 15, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 15, columns 5 and 7.

In a preferred embodiment of the invention the nucleic acid sequences as shown in table I, application no. 15, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 15, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.14] and [0032.0.0.14] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 15, column 3. Preferably the modification of the activity of a protein as shown in table II, application no. 15, column 3 or their combination can be achieved by joining the protein to a transit peptide.

Surprisingly it was found, that the transgenic expression of the *Saccaromyces cerevisiae* protein as shown in table II, application no. 15, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b0403 (Accession numberPIR:C64769) from *Escherichia coli* has been published in Blattner et al., Science 277 (5331), 1453-1474 (1997), and its activity is being defined as "maltodextrin glucosidase". Accordingly, in one embodiment, the process of the present invention comprises the use of a "maltodextrin glucosidase" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxy-tetracosenoic-acid, preferably 2-hydroxy-15-tetracosenoic acid in free or bound form in an organism or a part thereof, as mentioned. In one embodiment, in the process of the present invention the activity of a b0403 protein is increased or generated, e.g. from *Escherichia coli* or a homolog thereof, preferably linked at least to one transit peptide as mentioned for example in table V.

In another embodiment, in the process of the present invention the activity of a b0403 protein is increased or generated in a subcellular compartment of the organism or organism cell such as in an organelle like a plastid or mitochondria.

The sequence of b0488 (Accession number NP_415021) from *Escherichia coli* has been published in Blattner et al., Science 277 (5331), 1453-1474 (1997). Accordingly, in one embodiment, the process of the present invention comprises the use of its homolog, e.g. as shown herein, for the production of the fine chemical, meaning of 2-hydroxy palmitic acid and/or triglycerides, lipids, oils and/or fats containing 2-hydroxy palmitic acid, in particular for increasing the amount of 2-hydroxy palmitic acid in free or bound form in an organism or a part thereof, as mentioned. In one embodiment, in the process of the present invention the activity of a b0488 protein is increased or generated, e.g. from *Escherichia coli* or a homolog thereof, preferably linked at least to one transit peptide as mentioned for example in table V.

In another embodiment, in the process of the present invention the activity of a b0488 protein is increased or generated in a subcellular compartment of the organism or organism cell such as in an organelle like a plastid or mitochondria.

The sequence of b0598 (Accession number PIR: Q0ECNA) from *Escherichia coli* has been published in Blattner et al., Science 277 (5331), 1453-1474 (1997), and its activity is being defined as "carbon starvation protein". Accordingly, in one embodiment, the process of the present invention comprises the use of a "carbon starvation protein" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxytetracosenoic-acid, preferably 2-hydroxy-15-tetracosenoic acid in free or bound form in an organism or a part thereof, as mentioned. In one embodiment, in the process of the present invention the activity of a b0598 protein is increased or generated, e.g. from *Escherichia coli* or a homolog thereof, preferably linked at least to one transit peptide as mentioned for example in table V.

In another embodiment, in the process of the present invention the activity of a b0598 protein is increased or generated in a subcellular compartment of the organism or organism cell such as in an organelle like a plastid or mitochondria.

The sequence of b0621 (Accession number PIR:C64796) from *Escherichia coli* has been published in Blattner et al., Science 277 (5331), 1453-1474 (1997), and its activity is being defined as "dicarboxylate transport protein (DcuC family)". Accordingly, in one embodiment, the process of the present invention comprises the use of a "dicarboxylate transport protein (DcuC family)" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxy-tetracosenoic-acid, preferably 2-hydroxy-15-tetracosenoic acid in free or bound form in an organism or a part thereof, as mentioned. In one embodiment, in the process of the present invention the activity of a b0621 protein is increased or generated, e.g. from *Escherichia coli* or a homolog thereof, preferably linked at least to one transit peptide as mentioned for example in table V.

In another embodiment, in the process of the present invention the activity of a b0621 protein is increased or generated in a subcellular compartment of the organism or organism cell such as in an organelle like a plastid or mitochondria.

The sequence of b0720 (Accession number NP_415248) from *Escherichia coli* has been published in Blattner et al., Science 277 (5331), 1453-1474 (1997) and its activity is being defined as a "citrate synthase" Accordingly, in one embodiment, the process of the present invention comprises the use of a "citrate synthase" or its homolog, e.g. as shown herein, for the production of the fine chemical, meaning of 2-hydroxy palmitic acid and/or 2-hydroxy-tetracosenoic-acid, preferably 2-hydroxy-15-tetracosenoic acid and/or triglycerides, lipids, oils and/or fats containing 2-hydroxy palmitic acid and/or 2-hydroxy-tetracosenoic-acid, preferably 2-hydroxy-15-tetracosenoic acid, in particular for increasing the amount of 2-hydroxy palmitic acid and/or 2-hydroxy-tetracosenoic-acid, preferably 2-hydroxy-15-tetracosenoic acid in free or bound form in an organism or a part thereof, as mentioned. In one embodiment, in the process of the present invention the activity of a b0720 protein is increased or generated, e.g. from *Escherichia coli* or a homolog thereof, preferably linked at least to one transit peptide as mentioned for example in table V.

In another embodiment, in the process of the present invention the activity of a b0720 protein is increased or generated in a subcellular compartment of the organism or organism cell such as in an organelle like a plastid or mitochondria.

The sequence of b0931 (Accession number PIR:JQ0756) from *Escherichia coli* has been published in Blattner et al., Science 277 (5331), 1453-1474 (1997), and its activity is being defined as "nicotinate phosphoribosyltransferase". Accordingly, in one embodiment, the process of the present invention comprises the use of a "nicotinate phosphoribosyltransferase" or its homolog, e.g. as shown herein, for the production of the fine chemical, meaning of 2-hydroxy palmitic acid and/or triglycerides, lipids, oils and/or fats containing 2-hydroxy palmitic acid, in particular for increasing the amount of 2-hydroxy palmitic acid in free or bound form in an organism or a part thereof, as mentioned. In one embodiment, in the process of the present invention the activity of a b0931 protein is increased or generated, e.g. from *Escherichia coli* or a homolog thereof, preferably linked at least to one transit peptide as mentioned for example in table V.

In another embodiment, in the process of the present invention the activity of a b0931 protein is increased or generated in a subcellular compartment of the organism or organism cell such as in an organelle like a plastid or mitochondria.

The sequence of b1095 (Accession number NP_415613) from *Escherichia coli* has been published in Blattner et al., Science 277 (5331), 1453-1474 (1997), and its activity is being defined as "3-oxoacyl-[acyl-carrier-protein] synthase II". Accordingly, in one embodiment, the process of the present invention comprises the use of a "3-oxoacyl-[acyl-carrier-protein] synthase II" or its homolog, e.g. as shown herein, for the production of the fine chemical, meaning of hexadecenoic acid, preferably 9-hexadecenoic acid, more preferably trans-9-hexadecenoic acid and/or triglycerides, lipids, oils and/or fats containing hexadecenoic acid, preferably 9-hexadecenoic acid, more preferably trans-9-hexadecenoic acid, in particular for increasing the amount of hexadecenoic acid, preferably 9-hexadecenoic acid, more preferably trans-9-hexadecenoic acid in free or bound form in an organism or a part thereof, as mentioned. In one embodiment, in the process of the present invention the activity of a b1095 protein is increased or generated, e.g. from *Escherichia coli* or a homolog thereof, preferably linked at least to one transit peptide as mentioned for example in table V.

In another embodiment, in the process of the present invention the activity of a b1095 protein is increased or generated in a subcellular compartment of the organism or organism cell such as in an organelle like a plastid or mitochondria.

The sequence of b1625 (Accession number PIR:C64919) from *Escherichia coli* has been published in Blattner et al., Science 277 (5331), 1453-1474 (1997), and its activity is being defined as "putative hemolysin expression modulating protein HHA domain". Accordingly, in one embodiment, the process of the present invention comprises the use of a "putative hemolysin expression modulating protein HHA domain" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxy-tetracosenoic-acid, preferably 2-hydroxy-15-tetracosenoic acid in free or bound form in an organism or a part thereof, as mentioned. In one embodiment, in the process of the present invention the activity of a b1625 protein is increased or generated, e.g. from *Escherichia coli* or a homolog thereof, preferably linked at least to one transit peptide as mentioned for example in table V.

In another embodiment, in the process of the present invention the activity of a b1625 protein is increased or generated in a subcellular compartment of the organism or organism cell such as in an organelle like a plastid or mitochondria.

The sequence of b1627 (Accession number: NP_416144_) from *Escherichia coli* has been published in Blattner et al., Science 277 (5331), 1453-1474 (1997), and its activity is being defined as "putative oxidoreductase, inner membrane protein". Accordingly, in one embodiment, the process of the present invention comprises the use of a "putative oxidoreductase, inner membrane protein" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxy-tetracosenoic-acid, preferably 2-hydroxy-15-tetracosenoic acid in free or bound form in an organism or a part thereof, as mentioned. In one embodiment, in the process of the present invention the activity of a b1627 protein is increased or generated, e.g. from *Escherichia coli* or a homolog thereof, preferably linked at least to one transit peptide as mentioned for example in table V.

In another embodiment, in the process of the present invention the activity of a b1627 protein is increased or generated in a subcellular compartment of the organism or organism cell such as in an organelle like a plastid or mitochondria.

The sequence of b1700 (Accession number NP_416215) from *Escherichia coli* has been published in Blattner et al., Science 277 (5331), 1453-1474 (1997), and its activity is being defined as "putative 4Fe-4S ferredoxin-type protein". Accordingly, in one embodiment, the process of the present invention comprises the use of a "putative 4Fe-4S ferredoxin-type protein" or its homolog, e.g. as shown herein, for the production of the fine chemical, meaning of 2-hydroxy palmitic acid and/or octadecenoic acid, preferably 9-Octadecenoic acid, more preferably (Z)-9-octadecenoic acid and/or triglycerides, lipids, oils and/or fats containing 2-hydroxy palmitic acid and/or octadecenoic acid, preferably 9-Octadecenoic acid, more preferably (Z)-9-octadecenoic acid, in particular for increasing the amount of 2-hydroxy palmitic acid and/or octadecenoic acid, preferably 9-Octadecenoic acid, more preferably (Z)-9-octadecenoic acid in free or bound form in an organism or a part thereof, as mentioned. In one embodiment, in the process of the present invention the activity of a b1700 protein is increased or generated, e.g. from *Escherichia coli* or a homolog thereof, preferably linked at least to one transit peptide as mentioned for example in table V.

In another embodiment, in the process of the present invention the activity of a b1700 protein is increased or generated in a subcellular compartment of the organism or organism cell such as in an organelle like a plastid or mitochondria.

The sequence of b1900 (Accession number: PIR:S01074) from *Escherichia coli* has been published in Blattner et al., Science 277 (5331), 1453-1474 (1997), and its activity is being defined as "high-affinity L-arabinose transport protein (ABC superfamily, atp_bind)". Accordingly, in one embodiment, the process of the present invention comprises the use of a "high-affinity L-arabinose transport protein (ABC superfamily, atp_bind)" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxy-tetracosenoic-acid, preferably 2-hydroxy-15-tetracosenoic acid in free or bound form in an organism or a part thereof, as mentioned. In one embodiment, in the process of the present invention the activity of a b1900 protein is increased or generated, e.g. from *Escherichia coli* or a homolog thereof, preferably linked at least to one transit peptide as mentioned for example in table V.

In another embodiment, in the process of the present invention the activity of a b1900 protein is increased or generated in a subcellular compartment of the organism or organism cell such as in an organelle like a plastid or mitochondria.

The sequence of b1933 (Accession number PIR: B64957) from *Escherichia coli* has been published in Blattner et al., Science 277 (5331), 1453-1474 (1997), and its activity has not been characterized. Accordingly, in one embodiment, the process of the present invention comprises the use of a "b1933 protein" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxy-tetracosenoic-acid, preferably 2-hydroxy-15-tetracosenoic acid in free or bound form in an organism or a part thereof, as mentioned. In one embodiment, in the process of the present invention the activity of a b1933 protein is increased or generated, e.g. from *Escherichia coli* or a homolog thereof, preferably linked at least to one transit peptide as mentioned for example in table V.

In another embodiment, in the process of the present invention the activity of a b1933 protein is increased or generated in a subcellular compartment of the organism or organism cell such as in an organelle like a plastid or mitochondria.

The sequence of b1980 (Accession number F64962) from *Escherichia coli* has been published in Blattner et al., Science 277 (5331), 1453-1474 (1997), and its activity is being defined as "putative transport protein". Accordingly, in one embodiment, the process of the present invention comprises the use of a "putative transport protein" or its homolog, e.g. as shown herein, for the production of the fine chemical, meaning of 2-hydroxy palmitic acid and/or triglycerides, lipids, oils and/or fats containing 2-hydroxy palmitic acid, in particular for increasing the amount of 2-hydroxy palmitic acid in free or bound form in an organism or a part thereof, as mentioned. In one embodiment, in the process of the present invention the activity of a b1980 protein is increased or generated, e.g. from *Escherichia coli* or a homolog thereof, preferably linked at least to one transit peptide as mentioned for example in table V.

In another embodiment, in the process of the present invention the activity of a b1980 protein is increased or generated in a subcellular compartment of the organism or organism cell such as in an organelle like a plastid or mitochondria.

The sequence of b2284 (Accession number: PIR:B65000) from *Escherichia coli* has been published in Blattner et al., Science 277 (5331), 1453-1474 (1997), and its activity is being defined as "NADH2 dehydrogenase". Accordingly, in one embodiment, the process of the present invention comprises the use of a "NADH2 dehydrogenase" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxytetracosenoic-acid, preferably 2-hydroxy-15-tetracosenoic acid in free or bound form in an organism or a part thereof, as mentioned. In one embodiment, in the process of the present invention the activity of a b2284 protein is increased or generated, e.g. from *Escherichia coli* or a homolog thereof, preferably linked at least to one transit peptide as mentioned for example in table V.

In another embodiment, in the process of the present invention the activity of a b2284 protein is increased or generated in a subcellular compartment of the organism or organism cell such as in an organelle like a plastid or mitochondria.

The sequence of b2799 (Accession number: PIR:RDECLA) from *Escherichia coli* has been published in Blattner et al., Science 277 (5331), 1453-1474 (1997), and its activity is being defined as "lactaldehyde reductase". Accordingly, in one embodiment, the process of the present invention comprises the use of a "lactaldehyde reductase" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of 2-hydroxy-tetracosenoic-acid, preferably 2-hydroxy-15-tetracosenoic acid in free or bound form in an organism or a part thereof, as mentioned. In one embodiment, in the process of the present invention the activity of a b2799 protein is increased or generated, e.g. from *Escherichia coli* or a homolog thereof, preferably linked at least to one transit peptide as mentioned for example in table V.

In another embodiment, in the process of the present invention the activity of a b2799 protein is increased or generated in a subcellular compartment of the organism or organism cell such as in an organelle like a plastid or mitochondria.

The sequence of b3429 (Accession number NP_417887) from *Escherichia coli* has been published in Blattner et al., Science 277 (5331), 1453-1474 (1997), and its activity is being defined as "glycogen synthase". Accordingly, in one embodiment, the process of the present invention comprises the use of a "glycogen synthase" or its homolog, e.g. as shown herein, for the production of the fine chemical, meaning of hexadecadienoic acid, preferably delta 7, 10 hexadecadienoic acid and/or hexadecatrienoic acid, preferably delta 7, 10, 13 hexadecatrienoic acid, and/or triglycerides, lipids, oils and/or fats containing hexadecadienoic acid, preferably delta 7, 10 hexadecadienoic acid and/or hexadecatrienoic acid, preferably delta 7, 10, 13 hexadecatrienoic acid, in particular for increasing the amount of hexadecadienoic acid, preferably delta 7, 10 hexadecadienoic acid and/or hexadecatrienoic acid, preferably delta 7, 10, 13 hexadecatrienoic acid in free or bound form in an organism or a part thereof, as mentioned. In one embodiment, in the process of the present invention the activity of a b3429 protein is increased or generated, e.g. from *Escherichia coli* or a homolog thereof, preferably linked at least to one transit peptide as mentioned for example in table V.

In another embodiment, in the process of the present invention the activity of a b3429 protein is increased or generated in a subcellular compartment of the organism or organism cell such as in an organelle like a plastid or mitochondria.

The sequence of b3568 (Accession number PIR:S47789) from *Escherichia coli* has been published in Blattner et al., Science 277 (5331), 1453-1474 (1997), and its activity is being defined as "xylose transport permease protein xylH". Accordingly, in one embodiment, the process of the present invention comprises the use of a "V" or its homolog, e.g. as shown herein, for the production of the fine chemical, meaning of hexadecenoic acid, preferably 9-hexadecenoic acid, more preferably trans-9-hexadecenoic acid and/or 2-hydroxy-tetracosenoic-acid, preferably 2-hydroxy-15-tetracosenoic acid, and/or triglycerides, lipids, oils and/or fats containing hexadecenoic acid, preferably 9-hexadecenoic acid, more preferably trans-9-hexadecenoic acid and/or 2-hydroxy-tetracosenoic-acid, preferably 2-hydroxy-15-tetracosenoic acid, in particular for increasing the amount of hexadecenoic acid, preferably 9-hexadecenoic acid, more preferably trans-9-hexadecenoic acid and/or 2-hydroxy-tetracosenoic-acid, preferably 2-hydroxy-15-tetracosenoic acid in free or bound form in an organism or a part thereof, as mentioned. In one embodiment, in the process of the present invention the activity of a b3568 protein is increased or generated, e.g. from *Escherichia coli* or a homolog thereof, preferably linked at least to one transit peptide as mentioned for example in table V.

In another embodiment, in the process of the present invention the activity of a b3568 protein is increased or generated in a subcellular compartment of the organism or organism cell such as in an organelle like a plastid or mitochondria.

The sequence of b3708 (Accession number PIR:WZEC) from *Escherichia coli* has been published in Blattner et al., Science 277 (5331), 1453-1474 (1997), and its activity is being defined as "tryptophan deaminase PLP dependent". Accordingly, in one embodiment, the process of the present invention comprises the use of a "tryptophan deaminase" or its homolog, e.g. as shown herein, for the production of the fine chemical, meaning of 2-hydroxy palmitic acid and/or hexadecadienoic acid, preferably delta 7, 10 hexadecadienoic acid and/or hexadecatrienoic acid, preferably delta 7, 10, 13 hexadecatrienoic acid and/or any combination of two or all three of the fine chemicals selected from the group consisting of 2-hydroxy palmitic acid, hexadecadienoic acid, preferably delta 7, 10 hexadecadienoic acid and hexadecatrienoic acid, preferably delta 7, 10, 13 hexadecatrienoic acid and/or triglycerides, lipids, oils and/or fats containing 2-hydroxy palmitic acid and/or hexadecadienoic acid, preferably delta 7, 10 hexadecadienoic acid and/or any combination of two or all three of the fine chemicals selected from the group consisting of 2-hydroxy palmitic acid, hexadecadienoic acid, preferably delta 7, 10 hexadecadienoic acid and hexadecatrienoic acid, preferably delta 7, 10, 13 hexadecatrienoic acid, in particular for increasing the amount of 2-hydroxy palmitic acid and/or hexadecadienoic acid, preferably delta 7, 10 hexadecadienoic acid and/or hexadecatrienoic acid, preferably delta 7, 10, 13 hexadecatrienoic acid and/or any combination of two or all three of the fine chemicals selected from the group consisting of 2-hydroxy palmitic acid, hexadecadienoic acid, preferably delta 7, 10 hexadecadienoic acid and hexadecatrienoic acid, preferably delta 7, 10, 13 hexadecatrienoic acid in free or bound form in an organism or a part thereof, as mentioned. In one embodiment, in the process of the present invention the activity of a b3708 protein is increased or generated, e.g. from

*Escherichia coli* or a homolog thereof, preferably linked at least to one transit peptide as mentioned for example in table V.

In another embodiment, in the process of the present invention the activity of a b3708 protein is increased or generated in a subcellular compartment of the organism or organism cell such as in an organelle like a plastid or mitochondria.

The sequence of b3728 (Accession number PIR: BYECPR) from *Escherichia coli* has been published in Blattner et al., Science 277 (5331), 1453-1474 (1997), and its activity is being defined as "high affinity phosphate transport protein (ABC superfamily peri bind)". Accordingly, in one embodiment, the process of the present invention comprises the use of a "high affinity phosphate transport protein" or its homolog, e.g. as shown herein, for the production of the fine chemical, meaning of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid, in particular for increasing the amount of -hydroxy-tetracosenoic-acid, preferably 2-hydroxy-15-tetracosenoic acid in free or bound form in an organism or a part thereof, as mentioned. In one embodiment, in the process of the present invention the activity of a b3728 protein is increased or generated, e.g. from *Escherichia coli* or a homolog thereof, preferably linked at least to one transit peptide as mentioned for example in table V.

In another embodiment, in the process of the present invention the activity of a b3728 protein is increased or generated in a subcellular compartment of the organism or organism cell such as in an organelle like a plastid or mitochondria.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase" which catalyzes the first step in aromatic amino acid biosynthesis and is feedback-inhibited by phenylalanine (Aro3p). Accordingly, in one embodiment, the process of the present invention comprises the use of a "3-deoxy-D-arabino-heptulosonate-7-phosphate synthase" or its homolog, e.g. as shown herein, for the production of the fine chemical, meaning of heptadecanoic acid, and/or triglycerides, lipids, oils and/or fats containing heptadecanoic acid, in particular for increasing the amount of heptadecanoic acid in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of an YDR035W protein is increased or generated in a subcellular compartment of the organism or organism cell such as in an organelle like a plastid or mitochondria.

The sequence of YJR073C (Accession number PIR: B28443) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "unsaturated phospholipid N-methyl-transferase (methylene-fatty-acyl-phospholipid synthase)". Accordingly, in one embodiment, the process of the present invention comprises the use of a "unsaturated phospholipid N-methyltransferase (methylene-fatty-acyl-phospholipid synthase)" or its homolog, e.g. as shown herein, for the production of the fine chemical, meaning of hexadecadienoic acid, preferably delta 7, 10 hexadecadienoic acid, and/or triglycerides, lipids, oils and/or fats containing hexadecadienoic acid, preferably delta 7, 10 hexadecadienoic acid, in particular for increasing the amount of hexadecadienoic acid, preferably delta 7, 10 hexadecadienoic acid in free or bound form in an organism or a part thereof, as mentioned. In one embodiment, in the process of the present invention the activity of a YJR073C protein is increased or generated, e.g. from *Saccharomyces cerevisiae* or a homolog thereof, preferably linked at least to one transit peptide as mentioned for example in table V.

In another embodiment, in the process of the present invention the activity of an YJR073C protein is increased or generated in a subcellular compartment of the organism or organism cell such as in an organelle like a plastid or mitochondria.

The sequence of YNL241C (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as "glucose-6-phosphate dehydrogenase (Zwf1p)". Accordingly, in one embodiment, the process of the present invention comprises the use of said "glucose-6-phosphate dehydrogenase" or its homolog, e.g. as shown herein, for the production of the fine chemical, meaning of hexadecadienoic acid, preferably delta 7, 10 hexadecadienoic acid and/or hexadecatrienoic acid, preferably delta 7, 10, 13 hexadecatrienoic acid, and/or triglycerides, lipids, oils and/or fats containing hexadecadienoic acid, preferably delta 7, 10 hexadecadienoic acid and/or hexadecatrienoic acid, preferably delta 7, 10, 13 hexadecatrienoic acid, in particular for increasing the amount of hexadecadienoic acid, preferably delta 7, 10 hexadecadienoic acid and/or hexadecatrienoic acid, preferably delta 7, 10, 13 hexadecatrienoic acid in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of an YNL241C protein is increased or generated in a subcellular compartment of the organism or organism cell such as in an organelle like a plastid or mitochondria.

In one embodiment, the homolog of the YDR035W, YJR073C and/or YNL241C, is a homolog having said activity and being derived from Eukaryot. In one embodiment, the homolog of the b0403, b0488, b0598, b0621, b0720, b0931, b1095, b1625, b1627, b1700, b1900, b1933, b1980, b2284, b2799, b3429, b3568, b3708 and/or b3728 is a homolog having said activity and being derived from bacteria. In one embodiment, the homolog of the YDR035W, YJR073C and/or YNL241C is a homolog having said activity and being derived from Fungi. In one embodiment, the homolog of the b0403, b0488, b0598, b0621, b0720, b0931, b1095, b1625, b1627, b1700, b1900, b1933, b1980, b2284, b2799, b3429, b3568, b3708 and/or b3728 is a homolog having said activity and being derived from Proteobacteria. In one embodiment, the homolog of the YDR035W, YJR073C and/or YNL241C is a homolog having said activity and being derived from Ascomycota. In one embodiment, the homolog of the b0403, b0488, b0598, b0621, b0720, b0931, b1095, b1625, b1627, b1700, b1900, b1933, b1980, b2284, b2799, b3429, b3568, b3708 and/or b3728 is a homolog having said activity and being derived from Gammaproteobacteria. In one embodiment, the homolog of the YDR035W, YJR073C and/or YNL241C is a homolog having said activity and being derived from *Saccharomycotina*. In one embodiment, the homolog of the b0403, b0488, b0598, b0621, b0720, b0931, b1095, b1625, b1627, b1700, b1900, b1933, b1980, b2284, b2799, b3429, b3568, b3708 and/or b3728 is a homolog having said activity and being derived from Enterobacteriales. In one embodiment, the homolog of the YDR035W, YJR073C and/or YNL241C is a homolog having said activity and being derived from *Saccharomycetes*. In one embodiment, the homolog of the b0403, b0488, b0598, b0621, b0720, b0931, b1095, b1625, b1627, b1700, b1900, b1933, b1980, b2284, b2799, b3429, b3568, b3708 and/or b3728 is a homolog having said activity and being derived from Enterobacteriaceae. In one embodiment, the homolog of the YDR035W, YJR073C and/or YNL241C is a homolog having said activity and being derived from *Saccharomycetales*. In one embodiment, the homolog of the b0403, b0488, b0598, b0621, b0720, b0931, b1095, b1625, b1627, b1700, b1900, b1933, b1980, b2284, b2799, b3429, b3568, b3708 and/or b3728 is a homolog having said activity and being derived from *Escherichia*, preferably from *Escherichia coli*. In one embodiment, the homolog of the YDR035W, YJR073C and/or YNL241C is a homolog having said activity and being derived from Saccharomycetaceae. In one embodiment, the homolog of the YDR035W, YJR073C and/or YNL241C is a homolog having said activity and being derived from *Saccharomycetes*, preferably from *Saccharomyces cerevisiae*.

Homologs of the polypeptide table II, application no. 15, column 5 may be the polypeptides encoded by the nucleic acid molecules indicated in table I, application no. 15, column 7, resp., or may be the polypeptides indicated in table II, application no. 15, column 7, resp.

for the disclosure of this paragraph see paragraph [0038.0.0.0] above.

In accordance with the invention, a protein or polypeptide has the "activity of an protein as shown in table II, application no. 15, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 15, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 15, column 3, or which has at least 10% of the original enzymatic activity, preferably 20%, particularly preferably 30%, most particularly preferably 40% in comparison to a protein as shown in table II, application no. 7, column 3 of *Saccharomyces cerevisiae*.

for the disclosure of the paragraphs [0040.0.0.14] to [0047.0.0.14] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 15, column 3 its biochemical or genetical causes and the increased amount of the fine chemical.

for the disclosure of the paragraphs [0049.0.0.14] to [0051.0.0.14] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table 1, application no. 15, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.14] to [0058.0.0.14] see paragraphs [0053.0.0.0] to [0058.0.0.0] above.

In case the activity of the *Escherichia coli* protein b0403 or its homologs, e.g. a "maltodextrin glucosidase" is increased advantageously in an organelle such as a plastid or mitochondria, preferably, in one embodiment an increase of the fine chemical, preferably of 2-hydroxy-tetracosenoic-acid, preferably 2-hydroxy-15tetracosenoic-acid and/or triglycerides, lipids, oils and/or fats containing 2-hydroxy-tetracosenoic-acid, preferably 2-hydroxy-15-tetracosenoic acid between 23% and 43% or more is conferred.

In case the activity of the *Escherichia coli* protein b0488 or its homologs is increased advantageously in an organelle such as a plastid or mitochondria, preferably, in one embodiment an increase of the fine chemical, preferably of 2-hydroxy palmitic and/or triglycerides, lipids, oils and/or fats containing 2-hydroxy palmitic between 20% and 29% or more is conferred.

In case the activity of the *Escherichia coli* protein b0598 or its homologs e.g. a "carbon starvation protein" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 24% and 38% or more is conferred. In case the activity of the *Escherichia coli* protein b0621 or its homologs e.g. a "dicarboxylate transport protein (DcuC family)" is increased advantageously in an organelle such as a plastid or mitochondria, preferably, in one embodiment an increase of the fine chemical, preferably of 2-hydroxy-tetracosenoic-acid, preferably 2-hydroxy-15tetracosenoic acid and/or triglycerides, lipids, oils and/or fats containing 2-hydroxytetracosenoic-acid, preferably 2-hydroxy-15-tetracosenoic acid between 24% and 34% or more is conferred.

In case the activity of the *Escherichia coli* protein b0720 or its homologs e.g. a "citrate synthase" is increased advantageously in an organelle such as a plastid or mitochondria, preferably, in one embodiment an increase of the fine chemical, preferably of 2hydroxy palmitic acid and/or triglycerides, lipids, oils and/or fats containing 2-hydroxy palmitic acid between 18% and 28% or more is conferred and/or of 2-hydroxytetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 22% and 59% or more is conferred.

In case the activity of the *Escherichia coli* protein b0931 or its homologs, e.g. a "nicotinate phosphoribosyltransferase" is increased advantageously in an organelle such as a plastid or mitochondria, preferably, in one embodiment an increase of the fine chemical, preferably of 2-hydroxy palmitic acid and/or triglycerides, lipids, oils and/or fats containing 2-hydroxy palmitic acid between 20% and 33% or more is conferred. In case the activity of the *Escherichia coli* protein b1095 or its homologs, e.g. a "3oxoacyl-[acyl-carrier-protein] synthase II" is increased advantageously in an organelle such as a plastid or mitochondria, preferably, in one embodiment an increase of the fine chemical, preferably of hexadecenoic acid, preferably 9-hexadecenoic acid, more preferably trans-9-hexadecenoic acid and/or triglycerides, lipids, oils and/or fats containing hexadecenoic acid, preferably 9-hexadecenoic acid, more preferably trans-9hexadecenoic acid between 24% and 52% or more is conferred.

In case the activity of the *Escherichia coli* protein b1625 or its homologs, e.g. a "putative hemolysin expression modulating protein HHA domain" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 23% and 39% or more is conferred.

In case the activity of the *Escherichia coli* protein b1627 or its homologs, e.g. a "putative oxidoreductase, inner membrane protein" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic and/or triglycerides, lipids, oils and/or fats containing 2-hydroxy-tetracosenoic-acid, preferably 2-hydroxy-15-tetracosenoic between 25% and 42% or more is conferred.

In case the activity of the *Escherichia coli* protein b1700 or its homologs, e.g. a "putative 4Fe-4S ferredoxin-type protein" is increased advantageously in an organelle such as a plastid or mitochondria, preferably, in one embodiment an increase of the fine chemical, preferably of oleic acid and/or triglycerides, lipids, oils and/or fats containing oleic acid between 23% and 87% or more is conferred and or of 2-hydroxy palmitic acid and/or triglycerides, lipids, oils and/or fats containing 2-hydroxy palmitic acid between 17% and 20% or more is conferred In case the activity of the *Escherichia coli* protein b1900 or its homologs, e.g. a "high-affinity L-arabinose transport protein (ABC superfamily, atp_bind)" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 25% and 35% or more is conferred.

In case the activity of the *Escherichia coli* protein b1933 or its homologs, e.g. a "b1933 protein with unknown biological function" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 22% and 26% or more is conferred.

In case the activity of the *Escherichia coli* protein b1980 or its homologs, e.g. a "putative transport protein" is increased advantageously in an organelle such as a plastid or mitochondria, preferably, in one embodiment an increase of the fine chemical, preferably of 2-hydroxy palmitic acid and/or triglycerides, lipids, oils and/or fats containing 2hydroxy palmitic acid between 20% and 27% or more is conferred.

In case the activity of the *Escherichia coli* protein b2284 or its homologs, e.g. a "NADH2 dehydrogenase" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 30% and 65% or more is conferred.

In case the activity of the *Escherichia coli* protein b2799 or its homologs, e.g. a "lactaldehyde reductase" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 27% and 43% or more is conferred. In case the activity of the *Escherichia coli* protein b3429 or its homologs, e.g. a "glycogen synthase" is increased advantageously in an organelle such as a plastid or mitochondria, preferably, in one embodiment an increase of the fine chemical, preferably of hexadecadienoic acid, preferably delta 7, 10 hexadecadienoic acid and/or triglycerides, lipids, oils and/or fats containing hexadecadienoic acid, preferably delta 7, 10 hexadecadienoic acid between 31% and 83% or more and/or of hexadecatrienoic acid, preferably delta 7, 10, 13 hexadecatrienoic acid and/or triglycerides, lipids, oils and/or fats containing hexadecatrienoic acid, preferably delta 7, 10, 13 hexadecatrienoic acid between 13% and 39% or more is conferred.

In case the activity of the *Escherichia coli* protein b3568 or its homologs, e.g. a "xylose transport permease protein xylH" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 22% and 49% or more and/or of hexadecenoic acid, preferably 9-hexadecenoic acid, more preferably trans-9-hexadecenoic acid and/or triglycerides, lipids, oils and/or fats containing hexadecenoic acid, preferably 9-hexadecenoic acid, more preferably trans-9-hexadecenoic acid between 22% and 38% or more is conferred.

In case the activity of the *Escherichia coli* protein b3708 or its homologs, e.g. a "tryptophan deaminase PLP dependent" is increased advantageously in an organelle such as a plastid or mitochondria, preferably, in one embodiment an increase of the fine chemical, preferably of 2-hydroxy palmitic acid and/or triglycerides, lipids, oils and/or fats containing 2-hydroxy palmitic acid between 22% and 29% or more and/or of hexadecadienoic acid, preferably delta 7, 10 hexadecadienoic acid and/or triglycerides, lipids, oils and/or fats containing hexadecadienoic acid, preferably delta 7, 10 hexadecadienoic acid between 23% and 84% or more and/or of hexadecatrienoic acid, preferably delta 7, 10, 13 hexadecatrienoic acid and/or triglycerides, lipids, oils and/or fats containing hexadecatrienoic acid, preferably delta 7, 10, 13 hexadecatrienoic acid between 16% and 32% or more and/or an increase of any combination of two or all three of the fine chemicals selected from the group consisting of 2-hydroxy palmitic acid, hexadecadienoic acid, preferably delta 7, 10 hexadecadienoic acid and hexadecatrienoic acid, preferably delta 7, 10, 13 hexadecatrienoic acid of 16% to 84% or more is conferred. In case the activity of the *Escherichia coli* protein b3728 or its homologs, e.g. a "high affinity phosphate transport protein (ABC superfamily peri bind)" is increased advantageously in an organelle such as a plastid or mitochondria, preferably, in one embodiment an increase of the fine chemical, preferably of 2-hydroxy-tetracosenoic-acid, preferably 2-hydroxy-15-tetracosenoic acid and/or triglycerides, lipids, oils and/or fats containing 2-hydroxy-tetracosenoic-acid, preferably 2-hydroxy-15-tetracosenoic acid between 22% and 30% or more is conferred.

In case the activity of the *Saccharomyces cerevisiae* protein YDR035W or its homologs, e.g. a "3-deoxy-D-arabinoheptulosonate-7-phosphate synthase" is increased advantageously in an organelle such as a plastid or mitochondria, preferably, in one embodiment an increase of the fine chemical, preferably of heptadecanoic acid and/or triglycerides, lipids, oils and/or fats containing heptadecanoic acid between 21% and 40% or more is conferred.

In case the activity of the *Saccharomyces cerevisiae* protein YJR073C or its homologs, e.g. a "unsaturated phospholipid N-methyltransferase (methylene-fatty-acyl-phospholipid synthase)" is increased advantageously in an organelle such as a plastid or mitochondria, preferably, in one embodiment an increase of the fine chemical, preferably of hexadecadienoic acid, preferably delta 7, 10 hexadecadienoic acid and/or triglycerides, lipids, oils and/or fats containing hexadecadienoic acid, preferably delta 7, 10 hexadecadienoic acid between 22% and 41% or more is conferred.

In case the activity of the *Saccharomyces cerevisiae* protein YNL241C or its homologs, e.g. a "glucose-6-phosphate dehydrogenase" is increased advantageously in an organelle such as a plastid or mitochondria, preferably, in one embodiment an increase of the fine chemical, preferably of hexadecadienoic acid, preferably delta 7, 10 hexadecadienoic acid, and/or triglycerides, lipids, oils and/or fats containing hexadecadienoic acid, preferably delta 7, 10 hexadecadienoic acid between 22% and 36% or more and/or of hexadecatrienoic acid, preferably delta 7, 10, 13 hexadecatrienoic acid and/or triglycerides, lipids, oils and/or fats containing hexadecatrienoic acid, preferably delta 7, 10, 13 hexadecatrienoic acid between 17% and 24% or more is conferred.

In case the activity of any of the *Escherichia coli* proteins b0403, b0488, b0598, b0621, b0720, b0931, b1095, b1625, b1627, b1700, b1900, b1933, b1980, b2284, b2799, b3429, b3568, b3708 and/or b3728 or their homologs," are increased advantageously in an organelle such as a plastid or mitochondria, preferably an increase of the fine chemical indicated in column 6 "metabolites" for application no. 15 in any one of Tables I to IV, resp., and/or triglycerides, lipids, oils and/or fats containing the fine chemical indicated in column 6 "metabolites" for application no. 15 in any one of Tables I to IV, resp., is conferred.

In case the activity of the *Saccharomyces cerevisiae* protein YDR035W, YJR073C and/or YNL241C or its homologs is increased advantageously in an organelle such as a plastid or mitochondria, preferably an increase of the fine chemical indicated in column 6 "metabolites" for application no. 15 in any one of Tables I to IV, resp., and/or triglycerides, lipids, oils and/or fats containing the fine chemical indicated in column 6 "metabolites" for application no. 15 in any one of Tables I to IV, resp., is conferred.

for the disclosure of the paragraphs [0061.0.0.14] and [0062.0.0.14] see paragraphs [0061.0.0.0] and [0062.0.0.0] above.

A protein having an activity conferring an increase in the amount or level of the fine chemical, preferably upon targeting to the plastids preferably has in one embodiment the structure of the polypeptide described herein, in particular of the polypeptides comprising the consensus sequence shown in table IV, application no. 15, column 7 or of the polypeptide as shown in the amino acid sequences as disclosed in table II, application no. 15, columns 5 and 7 or the functional homologues thereof as described herein, or is encoded by the nucleic acid molecule characterized herein or the nucleic acid molecule according to the invention, for example by the nucleic acid molecule as shown in table 1, application no. 15, columns 5 and 7 or its herein described functional homologues and has the herein mentioned activity.

For the purposes of the present invention, the reference to the fine chemical, e.g. to the term "hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid", also encompasses the corresponding salts, such as, for example, the potassium or sodium salts or the salts with amines such as diethylamine as well as triglycerides, lipids, oils and/or fats containing the respective fine chemical as indicated in column 6 "metabolites" for application no. 15 in any one of Tables I to IV, resp.

for the disclosure of the paragraphs [0065.0.0.14] and [0066.0.0.14] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 15, columns 5 and 7 or its homologs activity having herein-mentioned hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table 1, application no. 15, columns 5 and 7, e.g. a nucleic acid sequence encoding a polypeptide having the activity of a protein as indicated in table II, application no. 15, columns 5 and 7 or its homologs activity or of a mRNA encoding the polypeptide of the present invention having herein-mentioned hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenioc acid and/or hexadecatrienoic acid, preferably delta 7, 10, 13 hexadecatrienoic acid increasing activity; and/or c) increasing the specific activity of a protein conferring the increased expression of a protein encoded by the nucleic acid molecule of the invention or of the polypeptide of the present invention having herein-mentioned hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity, e.g. of a polypeptide having the activity of a protein as indicated in table II, application no. 15, columns 5 and 7 or its homologs activity, or decreasing the inhibitiory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity, e.g. of a polypeptide having the activity of a protein as indicated in table II, application no. 15, columns 5 and 7 or its homologs activity; and/or e) stimulating activity of a protein conferring the increased expression of a protein encoded by the nucleic acid molecule of the present invention or a polypeptide of the present invention having herein-mentioned hexadecenoic acid, preferably 9hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity, e.g. of a polypeptide having the activity of a protein as indicated in table II, application no. 15, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned hexadecenoic acid, preferably 9-hexadecenoic acid, more preferably trans-9hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity, e.g. of a polypeptide having the activity of a protein as indicated in table II, application no. 15, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned hexadecenoic acid, preferably 9-hexadecenoic acid, more preferably trans-9hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity, e.g. of a polypeptide having the activity of a protein as indicated in table II, application no. 15, columns 5 and 7 or its homologs activity; and/or h) increasing the expression of the endogenous gene encoding the polypeptide of the invention, e.g. a polypeptide having the activity of a protein as indicated in table II, application no. 15, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity, e.g. of polypeptide having the activity of a protein as indicated in table II, application no. 15, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned Palmitic acid increasing activity, e.g. of a polypeptide having the activity of a protein as indicated in table II, application no. 15, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid increasing activity, e.g. of a polypeptide having the activity of a protein as indicated in table II, application no. 15, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in or ganelles such as plastids or having the activity of a polypeptide having an activity as the protein as shown in table II, application no. 15, column 3 or its homologs. Preferably the increase of the fine chemical takes place in plastids.

for the disclosure of the paragraphs [0069.0.0.14] to [0079.0.0.14] see paragraphs [0069.0.0.0] to [0079.0.0.0] above.

The activation of an endogenous polypeptide having above-mentioned activity, e.g. having the activity of a protein as shown in table II, application no. 15, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 15, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 15, column 3. The expression of the chimeric transcription factor in a organism, in particular in a plant, leads to a specific expression of the protein as shown in table II, application no. 15, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.14] to [0084.0.0.14] see paragraphs [0081.0.0.0] to [0084.0.0.0] above.

for the disclosure of the paragraph [0085.0.8.14] see paragraphs [0085.0.8.8] above.

for the disclosure of this paragraph see paragraph [0086.0.0.0] above.

By influencing the metabolism thus, it is possible to produce, in the process according to the invention, further advantageous compounds. Examples of such compounds are, in addition to the fine chemical of the invention as indicated in column 6 "metabolites" for application no. 15 in any one of Tables I to IV, resp., triglycerides, lipids, oils and/or fats containing these compounds like other fatty acids such as palmitate, stearate, palmitoleate, oleate, linoleate and/or linoleate or erucic acid and/or, arachidonic acid.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 15, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound fatty acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound fatty acids, in particular palmitate, stearate, palmitoleate, oleate, linoleate and/or linoleate or erucic acid and/or, arachidonic acid.

for the disclosure of the paragraphs [0090.0.0.14] to [0097.0.0.14] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 15, columns 5 and 7 or a derivative thereof, or
b) a genetic regulatory element, for example a promoter, which is functionally linked to the nucleic acid sequence as shown table I, application no. 15, columns 5 and 7 or a derivative thereof, or
c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 15, columns 5 and 7 joined to a nucleic acid sequence encoding a transit peptide, or a targeting nucleic acid sequence which directs the nucleic acid sequences disclosed in table I, application no. 15, columns 5 and 7 to the organelle preferentially the plastids. Altenatively the inventive nucleic acids sequences consist advantageously of the nucleic acid sequences as depicted in the sequence protocol and disclosed in table I, application no. 15, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose fatty acid content is modified advantageously owing to the nucleic acid molecule of the present invention expressed. This is important for plant breeders since, for example, the nutritional value of plants for poultry is dependent on the abovementioned essential fatty acids and the general amount of fatty acids as energy source in feed. After the activity of the protein as shown in table II, application no. 15, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.14] to [0110.0.0.14] see paragraphs [0102.0.0.0] to [0110.0.0.0] above.

In a preferred embodiment, the fine chemical (as indicated in column 6 "metabolites" for application no. 15 in any one of Tables I to IV, resp.) is produced in accordance with the invention and, if desired, is isolated. The production of further fatty acids such as palmitate, stearate, palmitoleate, oleate, linoleate and/or linoleate or erucic acid and/or, arachidonic acid and/or mixtures thereof or mixtures of other fatty acids by the process according to the invention is advantageous. It may be advantageous to increase the pool of free fatty acids in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example a fatty acid transporter protein or a compound, which functions as a sink for the desired fatty acid in the organism is useful to increase the production of the respective fine chemical (see Bao and Ohlrogge, Plant Physiol. 1999 August; 120 (4): 1057-1062). Such fatty acid transporter protein may serve as a link between the location of fatty acid synthesis and the socalled sink tissue, in which fatty acids, triglycerides, oils and fats are stored.

for the disclosure of the paragraphs [0113.0.5.14] to [0115.0.5.14] see paragraphs [0113.0.5.5] to [0115.0.5.5] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 15, columns 5 and 7 or a fragment thereof, which confers an increase in the amount of the respective fine chemical in an organism or a part thereof;
) nucleic acid molecule comprising, preferably at least the mature form, of the nucleic acid molecule shown in table I, application no. 15, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybidizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the repective fine chemical in an organism or a part thereof;

h) nucleic acid molecule comprising a nucleic acid molecule which is obtained by amplifying nucleic acid molecules from a cDNA library or a genomic library using the primers shown in table III, application no. 15, column 7 and conferring an increase in the amount of the respective fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;

j) nucleic acid molecule which encodes a polypeptide comprising the consensus sequence shown in table IV, application no. 15, column 7 and conferring an increase in the amount of the respective fine chemical in an organism or a part thereof;

k) nucleic acid molecule comprising one or more of the nucleic acid molecule encoding the amino acid sequence of a polypeptide encoding a domain of the polypeptide shown in table II, application no. 15, columns 5 and 7 and conferring an increase in the amount of the respective fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in table IA, application no. 15, columns 5 and 7 by one or more nucleotides. In one embodiment, the nucleic acid molecule used in the process of the invention does not consist of the sequence indicated in table IA, application no. 15, columns 5 and 7. In one embodiment, the nucleic acid molecule used in the process of the invention is less than 100%, 99.999%, 99.99%, 99.9% or 99% identical to a sequence indicated in table IA, application no. 15, columns 5 and 7. In another embodiment, the nucleic acid molecule does not encode code a polypeptide of a sequence indicated in table IIA, application no. 15, columns 5 and 7.

In one embodiment, the nucleic acid molecule used in the process of the invention distinguishes over the sequence indicated in table IB, application no. 15, columns 5 and 7, by one or more nucleotides. In one embodiment, the nucleic acid molecule used in the process of the invention does not consist of the sequence indicated in table IB, application no. 15, columns 5 and 7. In one embodiment, the nucleic acid molecule used in the process of the invention is less than 100%, 99.999%, 99.99%, 99.9% or 99% identical to a sequence indicated in table IB, application no. 15, columns 5 and 7. In another embodiment, the nucleic acid molecule does not encode a polypeptide of a sequence indicated in table IIB, application no. 15, columns 5 and 7.

In one embodiment, the nucleic acid molecule used in the process distinguishes over the sequence shown in table I, application no. 15, columns 5 and 7 by one or more nucleotides or does not consist of the sequence shown in table I, application no. 15, columns 5 and 7. In one embodiment, the nucleic acid molecule of the present invention is less than 100%, 99.999%, 99.99%, 99.9% or 99% identical to the sequence shown in table I, application no. 15, columns 5 and 7. In another embodiment, the nucleic acid molecule does not encode a polypeptide of the sequence shown in table II, application no. 15, columns 5 and 7.

for the disclosure of the paragraphs [0118.0.0.14] to [0120.0.0.14] see paragraphs [0118.0.0.0] to [0120.0.0.0] above.

Nucleic acid molecules with the sequence shown in table I, application no. 15, columns 5 and 7, nucleic acid molecules which are derived from the amino acid sequences shown in table II, application no. 15, columns 5 and 7 or from polypeptides comprising the consensus sequence shown in table IV, application no. 15, column 7, or their derivatives or homologues encoding polypeptides with the enzymatic or biological activity of a protein as shown in table II, application no. 15, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 15, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 15, column 3 and conferring the fine chemical increase by expression either in the cytsol or in an organelle such as a plastid or mitochondria or both, preferably in plastids.

for the disclosure of the paragraphs [0126.0.0.14] to [0133.0.0.14] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 15, columns 5 and 7 or the functional homologues thereof as described herein, preferably conferring above-mentioned activity, i.e. conferring the fine chemical increase after increasing its activity, e.g. after increasing the activity of a protein as shown in table II, application no. 15, column 3 by for example expression either in the cytsol or in an organelle such as a plastid or mitochondria or both, preferably in plastids.

for the disclosure of the paragraphs [0135.0.0.14] to [0140.0.0.14] see paragraphs [0135.0.0.0] to [0140.0.0.0] above.

Synthetic oligonucleotide primers for the amplification, e.g. as shown in table I, application no. 15, column 7, by means of polymerase chain reaction can be generated on the basis of a sequence shown herein, for example the sequence shown in table I, application no. 15, columns 5 and 7 or the sequences derived from table II, application no. 15, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 15, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 15, column 3 or further functional homologs of the polypeptide of the invention from other organisms.

for the disclosure of the paragraphs [0144.0.0.14] to [0151.0.0.14] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 15, columns 5 and 7, preferably of table IB, application no. 15, columns 5 and 7 under relaxed hybridization conditions and which code on expression for peptides having the hexadecenoic acid, preferably 9-hexadecenoic acid, more preferably trans-9hexadecenoic acid and/or
2-hydroxy palmitic acid and/or
heptadecanoic acid and/or
2-hydroxy-tetracosenoic-acid, preferably 2-hydroxy-15-tetracosenoic acid and/or
hexadecadienoic acid, preferably delta 7, 10 hexadecadienoic acid and/or
octadecenoic acid, preferably 9-Octadecenoic acid, more preferably (Z)-9-octadecenoic acid and/or
hexadecatrienoic acid, preferably delta 7, 10, 13 hexadecatrienoic acid, triglycerides, lipids, oils and/or fats containing hexadecenoic acid, preferably 9-hexadecenoic acid, more preferably trans-9-hexadecenoic acid and/or
2-hydroxy palmitic acid and/or
heptadecanoic acid and/or
2-hydroxy-tetracosenoic-acid, preferably 2-hydroxy-15-tetracosenoic acid and/or
hexadecadienoic acid, preferably delta 7, 10 hexadecadienoic acid and/or
octadecenoic acid, preferably 9-Octadecenoic acid, more preferably (Z)-9-octadecenoic acid and/or
hexadecatrienoic acid, preferably delta 7, 10, 13 hexadecatrienoic acid increasing activity.

for the disclosure of the paragraphs [0153.0.0.14] to [0159.0.0.14] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 15, columns 5 and 7, preferably shown in table IB, application no. 15, columns 5 and 7 is one which is sufficiently complementary to one of the nucleotide sequences shown in table I, application no. 15, columns 5 and 7, preferably shown in table IB, application no. 15, columns 5 and 7 such that it can hybridize to one of the nucleotide sequences shown in table I, application no. 15, columns 5 and 7, preferably shown in table IB, application no. 15, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 15, columns 5 and 7, preferably shown in table IB, application no. 15, columns 5 and 7, or a portion thereof and preferably has above mentioned activity, in particular having a fine chemical increasing activity after increasing the activity or an activity of a gene product as shown in table II, application no. 15, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 15, columns 5 and 7, preferably shown in table IB, application no. 15, columns 5 and 7, or a portion thereof and encodes a protein having above-mentioned activity, e.g. conferring of a hexadecenoic acid, preferably 9-hexadecenoic acid, more preferably trans-9hexadecenoic acid and/or
2-hydroxy palmitic acid and/or
heptadecanoic acid and/or
2-hydroxy-tetracosenoic-acid, preferably 2-hydroxy-15-tetracosenoic acid and/or
hexadecadienoic acid, preferably delta 7, 10 hexadecadienoic acid and/or
octadecenoic acid, preferably 9-Octadecenoic acid, more preferably (Z)-9-octadecenoic acid and/or
hexadecatrienoic acid, preferably delta 7, 10, 13 hexadecatrienoic acid, triglycerides, lipids, oils and/or fats containing hexadecenoic acid, preferably 9-hexadecenoic acid, more preferably trans-9-hexadecenoic acid and/or
2-hydroxy palmitic acid and/or
heptadecanoic acid and/or
2-hydroxy-tetracosenoic-acid, preferably 2-hydroxy-15-tetracosenoic acid and/or
hexadecadienoic acid, preferably delta 7, 10 hexadecadienoic acid and/or
octadecenoic acid, preferably 9-Octadecenoic acid, more preferably (Z)-9-octadecenoic acid and/or
hexadecatrienoic acid, preferably delta 7, 10, 13 hexadecatrienoic acid increase by for example expression either in the cytsol or in an organelle such as a plastid or mitochondria or both, preferably in plastids, and optionally, the activity of a protein as shown in table II, application no. 15, column 3.

Moreover, the nucleic acid molecule of the invention can comprise only a portion of the coding region of one of the sequences shown in table I, application no. 15, columns 5 and 7, preferably shown in table IB, application no. 15, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 15, columns 5 and 7, an anti-sense sequence of one of the sequences, e.g., set forth in table I, application no. 15, columns 5 and 7, preferably shown in table IB, application no. 15, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 15, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 15, columns 5 and 7 such that the protein or portion thereof maintains the ability to participate in the fine chemical production, in particular a hexadecenoic acid, preferably 9-hexadecenoic acid, more preferably trans-9-hexadecenoic acid and/or
2-hydroxy palmitic acid and/or
heptadecanoic acid and/or
2-hydroxy-tetracosenoic-acid, preferably 2-hydroxy-15-tetracosenoic acid and/or
hexadecadienoic acid, preferably delta 7, 10 hexadecadienoic acid and/or
octadecenoic acid, preferably 9-Octadecenoic acid, more preferably (Z)-9-octadecenoic acid and/or
hexadecatrienoic acid, preferably delta 7, 10, 13 hexadecatrienoic acid, triglycerides, lipids, oils and/or fats containing hexadecenoic acid, preferably 9-hexadecenoic acid, more preferably trans-9-hexadecenoic acid and/or
2-hydroxy palmitic acid and/or
heptadecanoic acid and/or
2-hydroxy-tetracosenoic-acid, preferably 2-hydroxy-15-tetracosenoic acid and/or
hexadecadienoic acid, preferably delta 7, 10 hexadecadienoic acid and/or octadecenoic acid, preferably 9-Octadecenoic acid, more preferably (Z)-9-octadecenoic acid and/or
hexadecatrienoic acid, preferably delta 7, 10, 13 hexadecatrienoic acid increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 15, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 15, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.14] and [0169.0.0.14] see paragraphs [0168.0.0.0] and [0169.0.0.0] above.

The invention further relates to nucleic acid molecules that differ from one of the nucleotide sequences shown in table I, application no. 15, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 15, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 15, columns 5 and 7 or the functional homologues. In a still further embodiment, the nucleic acid molecule of the invention encodes a full length protein which is substantially homologous to an amino acid sequence shown in table II, application no. 15, columns 5 and 7 or the functional homologues. However, in a preferred embodiment, the nucleic acid molecule of the present invention does not consist of the sequence shown in table I, application no. 15, columns 5 and 7, preferably as indicated in table IA, application no. 15, columns 5 and 7. Preferably the nucleic acid molecule of the invention is a functional homologue or identical to a nucleic acid molecule indicated in table IB, application no. 15, columns 5 and 7.

for the disclosure of the paragraphs [0171.0.0.14] to [0173.0.0.14] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 15, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 15, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 15, columns 5 and 7.

for the disclosure of the paragraphs [0179.0.0.14] and [0180.0.0.14] see paragraphs [0179.0.0.0] and [0180.0.0.0] above.

Accordingly, the invention relates to nucleic acid molecules encoding a polypeptide having above-mentioned activity, e.g. conferring an increase in the the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 15, columns 5 and 7, preferably shown in table IIA, application no. 15, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 15, columns 5 and 7, preferably shown in table IIA, application no. 15, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 15, columns 5 and 7, preferably shown in table IIA, application no. 15, columns 5 and 7, more preferably at least about 70% identical to one of the sequences shown in table II, application no. 15, columns 5 and 7, preferably shown in table IIA, application no. 15, columns 5 and 7, even more preferably at least about 80%, 90%, 95% homologous to the sequence shown in table II, application no. 15, columns 5 and 7, preferably shown in table IIA, application no. 15, columns 5 and 7, and most preferably at least about 96%, 97%, 98%, or 99% identical to the sequence shown in table II, application no. 15, columns 5 and 7, preferably shown in table IIA, application no. 15, columns 5 and 7.

for the disclosure of the paragraphs [0182.0.0.14] to [0188.0.0.14] see paragraphs [0182.0.0.0] to [0188.0.0.0] above.

Functional equivalents derived from one of the polypeptides as shown in table II, application no. 15, columns 5 and 7, preferably shown in table IIB, application no. 15, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 15, columns 5 and 7, preferably shown in table IIB, application no. 15, columns 5 and 7 resp., according to the invention and are distinguished by essentially the same properties as the polypeptide as shown in table II, application no. 15, columns 5 and 7, preferably shown in table IIB, application no. 15, columns 5 and 7.

Functional equivalents derived from the nucleic acid sequence as shown in table I, application no. 15, columns 5 and 7, preferably shown in table IB, application no. 15, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 15, columns 5 and 7, preferably shown in table IIB, application no. 15, columns 5 and 7 resp., according to the invention and encode polypeptides having essentially the same properties as the polypeptide as shown in table II, application no. 15, columns 5 and 7, preferably shown in table IIB, application no. 15, columns 5 and 7.

for the disclosure of this paragraph see paragraph [0191.0.0.0] above.

A nucleic acid molecule encoding an homologous to a protein sequence of table II, application no. 15, columns 5 and 7, preferably shown in table IIB, application no. 15, columns 5 and 7 resp., can be created by introducing one or more nucleotide substitutions, additions or deletions into a nucleotide sequence of the nucleic acid molecule of the present invention, in particular of table I, application no. 15, columns 5 and 7, preferably shown in table IB, application no. 15, columns 5 and 7 resp., such that one or more amino acid substitutions, additions or deletions are introduced into the encoded protein. Mutations can be introduced into the encoding sequences of table I, application no. 15, columns 5 and 7, preferably shown in table IB, application no. 15, columns 5 and 7 resp., by standard techniques, such as site-directed mutagenesis and PCR-mediated mutagenesis.

for the disclosure of the paragraphs [0193.0.0.14] to [0196.0.0.14] see paragraphs [0193.0.0.0] to [0196.0.0.0] above.

Homologues of the nucleic acid sequences used, with the sequence shown in table I, application no. 15, columns 5 and 7, preferably shown in table IB, application no. 15, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 15, columns 5 and 7, preferably shown in table IB, application no. 15, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 15, columns 5 and 7, preferably shown in table IB, application no. 15, columns 5 and 7. It is preferred that the nucleic acid molecule comprises as little as possible other nucleotides not shown in any one of table I, application no. 15, columns 5 and 7, preferably shown in table IB, application no. 15, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 15, columns 5 and 7, preferably shown in table IB, application no. 15, columns 5 and 7.

Also preferred is that the nucleic acid molecule used in the process of the invention encodes a polypeptide comprising the sequence shown in table II, application no. 15, columns 5 and 7, preferably shown in table IIB, application no. 15, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 15, columns 5 and 7, preferably shown in table IIB, application no. 15, columns 5 and 7.

In one embodiment, the nucleic acid molecule of the invention or used in the process encodes a polypeptide comprising the sequence shown in table II, application no. 15, columns 5 and 7, preferably shown in table IIB, application no. 15, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 15, columns 5 and 7, preferably shown in table IB, application no. 15, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 15, columns 5 and 7 expressed under identical conditions.

Homologues of table I, application no. 15, columns 5 and 7 or of the derived sequences of table II, application no. 15, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.14] to [0215.0.0.14] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 15, columns 5 and 7, preferably in table IIB, application no. 15, columns 5 and 7; or a fragment thereof conferring an increase in the amount of the respective fine chemical in an organism or a part thereof b) nucleic acid molecule comprising, preferably at least the mature form, of the nucleic acid molecule shown in table I, application no. 15, columns 5 and 7, preferably in table IB, application no. 15, columns 5 and 7 or a fragment thereof conferring an increase in the amount of the respective fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 15, column 7 and conferring an increase in the amount of the respective fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the respective fine chemical in an organism or a part thereof;

j) nucleic acid molecule which encodes a polypeptide comprising the consensus sequence shown in table IV, application no. 15, column 7 and conferring an increase in the amount of the respective fine chemical in an organism or a part thereof;

k) nucleic acid molecule encoding the amino acid sequence of a polypeptide encoding a domain of the polypeptide shown in table II, application no. 15, columns 5 and 7 and conferring an increase in the amount of the respective fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 15, columns 5 and 7 or a nucleic acid molecule encoding, preferably at least the mature form of, the polypeptide shown in table II, application no. 15, columns 5 and 7, and conferring an increase in the amount of the respective fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 15, columns 5 and 7 by one or more nucleotides. In one embodiment, the nucleic acid molecule of the invention does not consist of the sequence shown in table IA and/or IB, application no. 15, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 15, columns 5 and 7. In a further embodiment the nucleic acid molecule does not encode the polypeptide sequence shown in table IIA and/or IIB, application no. 15, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 15, columns 5 and 7 does not encode a protein of the sequence shown in table IIA and/or IIB, application no. 15, columns 5 and 7. Accordingly, in one embodiment, the protein encoded by a sequence of a nucleic acid accoriding to (a) to (l) does not consist of the sequence shown in table IA and/or IB, application no. 15, columns 5 and 7. In a further embodiment, the protein of the present invention is at least 30% identical to protein sequence depicted in table IIA and/or IIB, application no. 15, columns 5 and 7 and less than 100%, preferably less than 99.999%, 99.99% or 99.9%, more preferably less than 99%, 985, 97%, 96% or 95% identical to the sequence shown in table IIA and/or IIB, application no. 15, columns 5 and 7.

for the disclosure of the paragraphs [0217.0.0.14] to [0226.0.0.14] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 15, columns 5 and 7 can be cloned 3' prime to the transitpeptide encoding sequence, leading to a functional preprotein, which is directed to the plastids and which means that the mature protein fulfills its biological activity.

for the disclosure of the paragraphs [0228.0.0.14] to [0239.0.0.14] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 15, columns 5 and 7 or its derivatives, it is advantageous additionally to express and/or mutate further genes in the organisms. Especially advantageously, additionally at least one further gene of the fatty acid biosynthetic pathway such as for palmitate, palmitoleate, stearate and/or oleate is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 15, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.5.14] and [0242.0.5.14] see paragraphs [0241.0.5.5] and [0242.0.5.5] above.

In a further advantageous embodiment of the process of the invention, the organisms used in the process are those in which simultaneously a fatty acid degrading protein is attenuated, in particular by reducing the rate of expression of the corresponding gene.

for the disclosure of this paragraph see paragraph [0242.2.5.5] above.

for the disclosure of the paragraphs [0243.0.0.14] to [0264.0.0.14] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 15, columns 5 and 7 and described herein to achieve an expression in one of said compartments or extracellular.

for the disclosure of the paragraphs [0266.0.0.14] to [0287.0.0.14] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 15, columns 5 and 7 or their homologs is functionally linked to a plastidial targeting sequence. A further preferred embodiment of the invention relates to a vector in which a nucleic acid sequence encoding one of the polypeptides shown in table II, application no. 15, columns 5 and 7 or their homologs is functionally linked to a regulatory sequences which permit the expression in plastids.

for the disclosure of the paragraphs [0289.0.0.14] to [0296.0.0.14] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0403, anti-b0488, anti-b1410, anti-b1627, anti-b1758, anti-b1980, anti-b2066, anti-b2223, anti-b1095, ant-YPR035W and/or anti-YLR099C protein antibody or an antibody against polypeptides as shown in table II, application no. 15, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 15, columns 5 and 7 or as coded by the nucleic acid molecule shown in table I, application no. 15, columns 5 and 7 or functional homologues thereof.

In one advantageous embodiment, in the method of the present invention the activity of a polypeptide is increased comprising or consisting of the consensus sequence shown in table IV, application no. 15, columns 7 and in one another embodiment, the present invention relates to a polypeptide comprising or consisting of the consensus sequence shown in table IV, application no. 15, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.14] to [0304.0.0.14] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 15, columns 5 and 7 by one or more amino acids. In one embodiment, polypeptide distinguishes form the sequence shown in table IIA and/or IIB, application no. 15, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 15, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 15, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 15, columns 5 and 7 by one or more amino acids. In another embodiment, said polypeptide of the invention does not consist of the sequence shown in table IIA and/or IIB, application no. 15, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 15, columns 5 and 7.

In one embodiment, the present invention relates to a polypeptide having the activity of the protein as shown in table IIA and/or IIB, application no. 15, column 3, which distinguishes over the sequence depicted in table IIA and/or IIB, application no. 15, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.14] to [0311.0.0.14] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 15, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 15, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 15, columns 5 and 7 or which is homologous thereto, as defined above.

Accordingly the polypeptide of the present invention can vary from the sequences shown in table IIA and/or IIB, application no. 15, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 15, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 15, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 15, column 3. Differences shall mean at least one amino acid different from the sequences as shown in table II, application no. 15, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 15, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 15, column 3. The nucleic acid molecules and polypeptide molecules of the invention are expressed such that the yield, production, and/or efficiency of production of a desired compound is improved.

for the disclosure of the paragraphs [0320.0.0.14] to [0322.0.0.14] see paragraphs [0320.0.0.0] to [0322.0.0.0] above.

In one embodiment, a protein (=polypeptide) as shown in table II, application no. 15, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 15, column 3, e.g., a protein which does not confer the activity described herein and which is derived from the same or a different organism.

for the disclosure of the paragraphs [0324.0.0.14] to [0329.0.0.14] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 15, columns 5 and 7.

for the disclosure of the paragraphs [0331.0.0.14] to [0346.0.0.14] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 15, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 15, column 3 or a protein as shown in table II, application no. 15, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 15, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.14] to [0358.0.0.14] see paragraphs [0350.0.0.0] to [0358.0.0.0] above.

for the disclosure of the paragraph [0359.0.5.14] see paragraph [0359.0.5.5] above.

for the disclosure of the paragraphs [0360.0.0.14] to [0362.0.0.14] see paragraphs [0360.0.0.0] to [0362.0.0.0] above.

for the disclosure of the paragraphs [0363.0.5.14] to [0365.0.5.14] see paragraphs [0363.0.5.5] to [0365.0.5.5] above.

for the disclosure of the paragraphs [0366.0.0.14] to [0369.0.0.14] see paragraphs [0366.0.0.0] to [0369.0.0.0] above.

The fermentation broths obtained in this way, containing in particular the fine chemical as indicated in column 6 "metabolites" for application no. 15 in any one of Tables I to IV, resp., triglycerides, lipids, oils and/or fats containing the fine chemical as indicated in column 6 "metabolites" for application no. 15 in any one of Tables I to IV, resp, normally have a dry matter content of from 7.5 to 25% by weight. The fermentation broth can be processed further. Depending on requirements, the biomass can be seperated, such as, for example, by centrifugation, filtration, decantation or a combination of these methods, from the fermentation broth or left completely in it. Afterwards the biomass can be extracted without any further process steps or disrupted and then extracted. If necessary the fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction.

for the disclosure of this paragraph see paragraph [0371.0.5.5] above.

for the disclosure of the paragraphs [0372.0.0.14] to [0376.0.0.14], [0376.1.0.14] and [0377.0.0.14] see paragraphs [0372.0.0.0] to [0376.0.0.0], [0376.1.0.0] and [0377.0.0.0] above.

for the disclosure of the paragraph [0376.1.0.14] see paragraph [0376.1.0.0] above.

for the disclosure of the paragraph [0377.0.0.14] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
a) contacting, e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
b) identifying the nucleic acid molecules, which hybridize under relaxed stringent conditions with the nucleic acid molecule of the present invention in particular to the nucleic acid molecule sequence shown in table I, application no. 15, columns 5 and 7, preferably in table IB, application no. 15, columns 5 and 7, and, optionally, isolating the full length cDNA clone or complete genomic clone;
c) introducing the candidate nucleic acid molecules in host cells, preferably in a plant cell or a microorganism, appropriate for producing the fine chemical;
d) expressing the identified nucleic acid molecules in the host cells;
e) assaying the fine chemical level in the host cells; and
f) identifying the nucleic acid molecule and its gene product which expression confers an increase in the fine chemical level in the host cell after expression compared to the wild type.

for the disclosure of the paragraphs [0379.0.0.14] to [0383.0.0.14] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 15, column 3, e.g. comparing near identical organisms with low and high activity of the proteins as shown in table II, application no. 15, column 3.

for the disclosure of the paragraphs [0385.0.0.14] to [0404.0.0.14] see paragraphs [0385.0.0.0] to [0404.0.0.0] above.

for the disclosure of this paragraph see paragraph [0405.0.5.5] above.

for the disclosure of the paragraphs [0406.0.0.14] to [0435.0.0.14] see paragraphs [0406.0.0.0] to [0435.0.0.0] above.

Hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils and/or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid and/or octadecenoic acid, preferably 9-Octadecenoic acid, more preferably (Z)-9-octadecenoic acid and/or hexadecatrienoic acid, preferably delta 7, 10, 13 hexadecatrienoic acid production in *Mortierella*

The fatty acid production can be analysed as mentioned above. The proteins and nucleic acids can be analysed as mentioned below.

for the disclosure of the paragraphs [0437.0.0.14] and [0438.0.0.14] see paragraphs [0437.0.0.0] and [0438.0.0.0] above.

for the disclosure of the paragraphs [0439.0.5.14] and [0440.0.5.14] see paragraphs [0439.0.5.5] and [0440.0.5.5] above.

for the disclosure of this paragraph see [0441.0.0.0] above.

for the disclosure of the paragraphs [0442.0.5.14] and [0445.0.5.14] see paragraphs [0442.0.5.5] and [0445.0.5.5] above.

for the disclosure of the paragraphs [0446.0.0.14] to [0497.0.0.14] see paragraphs [0446.0.0.0] to [0497.0.0.0] above.

The results of the different plant analyses can be seen from the table, which follows:

TABLE VI

| ORF | Metabolite | Method/Analytics | Min.-Value | Max.-Value |
|---|---|---|---|---|
| b0403 | Nervonic acid (C24:1) | GC | 1.23 | 1.43 |
| b0488 | 2-Hydroxypalmitic acid (2-OH—C16:0) | GC | 1.20 | 1.29 |
| b0598 | Nervonic acid (C24:1) | GC | 1.24 | 1.38 |
| b0621 | Nervonic acid (C24:1) | GC | 1.24 | 1.34 |
| b0720 | 2-Hydroxypalmitic acid (2-OH—C16:0) | GC | 1.18 | 1.28 |
| b0720 | Nervonic acid (C24:1) | GC | 1.22 | 1.59 |
| b0931 | 2-Hydroxypalmitic acid (2-OH—C16:0) | GC | 1.20 | 1.33 |
| b1095 | trans-9-Hexadecenoic acid (C16:trans[9]1) | GC | 1.24 | 1.52 |
| b1625 | Nervonic acid (C24:1) | GC | 1.23 | 1.39 |
| b1627 | Nervonic acid (C24:1) | GC | 1.25 | 1.42 |
| b1700 | Oleic acid (C18:cis[9]1) | GC | 1.23 | 1.87 |
| b1700 | 2-Hydroxypalmitic acid (2-OH—C16:0) | GC | 1.17 | 1.20 |
| b1900 | Nervonic acid (C24:1) | GC | 1.25 | 1.35 |
| b1933 | Nervonic acid (C24:1) | GC | 1.22 | 1.26 |
| b1980 | 2-Hydroxypalmitic acid (2-OH—C16:0) | GC | 1.20 | 1.27 |
| b2284 | Nervonic acid (C24:1) | GC | 1.30 | 1.65 |
| b2799 | Nervonic acid (C24:1) | GC | 1.27 | 1.43 |
| b3429 | Hexadecadienoic acid (C16:cis[7,10]2) | GC | 1.31 | 1.83 |
| b3429 | Hexadecatrienoic acid (C16:cis[7,10,13]3) | GC | 1.13 | 1.39 |
| b3568 | Nervonic acid (C24:1) | GC | 1.22 | 1.49 |
| b3568 | trans-9-Hexadecenoic acid (C16:trans[9]1) | GC | 1.22 | 1.38 |
| b3708 | 2-Hydroxypalmitic acid (2-OH—C16:0) | GC | 1.22 | 1.29 |
| b3708 | Hexadecadienoic acid (C16:cis[7,10]2) | GC | 1.23 | 1.84 |
| b3708 | Hexadecatrienoic acid (C16:cis[7,10,13]3) | GC | 1.16 | 1.32 |
| b3728 | Nervonic acid (C24:1) | GC | 1.22 | 1.30 |
| YDR035W | Heptadecanoic acid (C17:0) | GC | 1.21 | 1.40 |
| YJR073C | Hexadecadienoic acid (C16:cis[7,10]2) | GC | 1.22 | 1.41 |
| YNL241C | Hexadecadienoic acid (C16:cis[7,10]2) | GC | 1.22 | 1.36 |
| YNL241C | Hexadecatrienoic acid (C16:cis[7,10,13]3) | GC | 1.17 | 1.24 | for the disclosure of the paragraphs [0499.0.0.14] and [0500.0.0.14] see paragraphs [0499.0.0.0] and [0500.0.0.0] above.

Example 15a

Engineering Ryegrass Plants by Over-expressing YDR035W from Saccharomyces cerevisiae or Homologs of YDR035W from Other Organisms for the disclosure of the paragraphs [0502.0.0.14] to [0508.0.0.14] see paragraphs [0502.0.0.0] to [0508.0.0.0] above.

Example 15b

Engineering Soybean Plants by Over-expressing YDR035W from Saccharomyces cerevisiae or homologs of YDR035W from other organisms for the disclosure of the paragraphs [0510.0.0.14] to [0513.0.0.14] see paragraphs [0510.0.0.0] to [0513.0.0.0] above.

Example 15c

Engineering Corn Plants by Over-expressing YDR035W from Saccharomyces cerevisiae or homologs of YDR035W from other organisms for the disclosure of the paragraphs [0515.0.0.14] to [0540.0.0.14] see paragraphs [0515.0.0.0] to [0540.0.0.0] above.

Example 15d

Engineering Wheat Plants by Over-expressing YDR035W from Saccharomyces cerevisiae or Homologs of YDR035W from Other Organisms for the disclosure of the paragraphs [0542.0.0.14] to [0544.0.0.14] see paragraphs [0542.0.0.0] to [0544.0.0.0] above.

Example 15e

Engineering Rapeseed/Canola Plants by Over-expressing YDR035W from Saccharomyces cerevisiae or Homologs of YDR035W from Other Organisms for the disclosure of the paragraphs [0546.0.0.14] to [0549.0.0.14] see paragraphs [0544.0.0.0] to [0549.0.0.0] above.

Example 15f

Engineering Alfalfa Plants by Over-expressing YDR035W from Saccharomyces cerevisiae or Homologs of YDR035W from Other Organisms for the disclosure of the paragraphs [0551.0.0.14] to [0554.0.0.14] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII as minimal (MIN) or maximal changes (MAX) in the respective fine chemical (column "metabolite") in genetically modified corn plants expressing the sequence listed in column 1 (ORF):

TABLE VII

| ORF | Metabolite | MIN | MAX |
|---|---|---|---|
| YDR035W | Heptadecanoic acid (C17:0) | 1.43 | 1.68 |

In one embodiment, in case the activity of the YDR035W from *Saccharomyces cerevisiae* is increased in corn plants, preferably, an increase of hetadecanoic acid between 43% and 68% or more is conferred.

for the disclosure of this paragraph see [0554.2.0.0] above.
for the disclosure of this paragraph see [0555.0.0.0] above.
for the disclosure of this paragraph see [0001.0.0.0].

The discovery in *Arabidopsis* of citramalaic acid (Fiehn et al. 2000 Nature Biotechnology 18, 1157-1161) a potential precursor of pyruvic acid and acetate suggests a novel aspect of carbon metabolism and furthermore suggests the existence of a tricarboxylic acid cycle bypass previously found only in bacteria.

Malic acid is an alpha-hydroxy organic acid. Its salt is named as malate. It is found in apples and other fruits and therefore named as fruit acid. Malic acid especially in the form of its anion malate, is a key intermediate in the major biochemical energy-producing cycle in cells known as the citric acid or Krebs cycle located in the cells' mitochondria.

It is an important compound together with magnesium for the treatment of fibromyalgia, a rheumatic illness which affects often middle-aged women.

D-Malate is an optically active compound which can be used as a synthon in organic synthesis, as a resolving agent and as a ligand in asymmetric catalysis.

The malic acid oxaloacetate shuttle is characteristic for plant cells. It transports redox equivalents intracellularly. Malic acid is not only a central metabolite in intermediary flow of carbon in organisms. In higher plants, vacuolar malic acid accumulation, and hence, transtonoplast malic acid transport, also plays a paramount role in many physiological functions. These include adjustment of osmotic and turgor potentials in extension growth and movements of stomata and pulvini, pH-regulation, e.g. during nitrate reduction, and others (for review, see Lüttge et al, Plant Physiol, 124(2000), 1335-1348).

Osawa and Matsumoto, Plant Physiol, 126(2001), 411-420 discuss the involvement of malic acid in aluminium resistance in plants. Malic acid is a common constituent of all plants, and its formation is controlled by an enzyme (protein catalyst) called malic acid dehydrogenase (MDH). Malic acid occupies a central role in plant metabolism. Its importance in plant mineral nutrition is reflected by the role it plays in symbiotic nitrogen fixation, phosphorus acquisition, and aluminum tolerance. During phosphorus deficiency, malic acid is frequently secreted from roots to release unavailable forms of phosphorus. In nitrogen-fixing root nodules, malic acid is the primary substrate for bacteroid respiration, thus fueling nitrogenase.

Citramalate (=(2S)-2-hydroxy-2-methylbutanedioate or (S)-2-Methylmalic acid) is an derivative of malic acid and produced from itaconic acid.

Pyruvic acid is a naturally occurring component in plants and vegetables and in the body, where it is inherently involved in metabolism, the process whereby energy is produced. Pyruvic acid represents the final step in the metabolism of glucose or starch. Increased pyruvic acid production in yeast strains is known (WO 04/099425).

Pyruvic acid is used commercially to produce its salts and esters (pyruvates) used as dietary supplements for the effect of enhancing weight loss. Pyruvic acid is used for the synthesis of amino acids (alanine, tyrosine, phenylalanine, and tryptophan) and used in biochemical research. Its derivatives are used in making food additives and flavoring agents.

Glyceric acid is an important precursor in the anabolism of amino acids, in particular for serin and glycin. Further, the energy level of a cell may be depend on the level of glyceric acid found. Glycerate and glycerate-3-phophate form a shuttle for the transportation of energy equivalents, e.g. during photorespiration between glycosomes and peroxisomes.

Glyceric acid has an diuretic effect.

Succinic acid is an intermediate of the citric acid cycle (and the glyoxylate cycle) produced by action of the enzyme succinyl-CoA synthetase on succinyl-CoA. Succinic acid is converted to fumaric acid by action of the enzyme succinic acid dehydrogenase (with formation of $FADH_2$).

It is used as flavoring agent for food and beverages. Succinic acid is an intermediate for a lot of chemical compounds such as dyes, perfumes, lacquers, photographic chemicals, alkyd resins or plasticizer. Furthermore it is also an intermediate used for the production of medicines used as sedatives, contraceptives or anticancer drugs.

Fumaric acid is another intermediate of the citric acid cycle (Krebs cycle). It is synthesized from succinic acid.

Fumarate, also called fumaric acid, is a useful compound in treatment of psoriasis, which is a chronic, incurable, disabling skin disease characterised by red, scaly plaques. Approximately 23% of psoriasis patients also have an accompanying arthritis that can become debilitating.

Threonolactone is another compound used for the treatment of dermatological disorders.

Due to these interesting physiological roles and agrobiotechnological potential of citramalic acid (=citramalate, hydroxypyrotartaric acid), glyceric acid (=glycerate), fumaric acid (=fumarate), malic acid (=malate), pyruvic acid (=pyruvate), succinic acid (=succinate) and/or threonolactone there is a need to identify the genes of enzymes and other proteins involved in citramalic acid, glyceric acid, fumaric acid, malic acid, pyruvic acid, succinic acid and/or threonolactone metabolism, and to generate mutants or transgenic plant lines, which are able to modify the citramalic acid, glyceric acid, fumaric acid, malic acid, pyruvic acid, succinic acid and/or threonolactone content in the plant.

One way to increase the productive capacity of biosynthesis is to apply recombinant DNA technology. Thus, it would be desirable to produce citramalic acid, glyceric acid, fumaric acid, malic acid, pyruvic acid, succinic acid and/or threonolactone in plants. That type of production permits control over quality, quantity and selection of the most suitable and efficient producer organisms. The latter is especially important for commercial production economics and therefore availability to consumers.

Methods of recombinant DNA technology have been used for some years to improve the production of fine chemicals in microorganisms and plants by amplifying individual biosynthesis genes and investigating the effect on production of fine chemicals.

Thus, it would be advantageous if an algae, plant or other microorganism were available which produce large amounts citramalic acid, glyceric acid, fumaric acid, malic acid, pyruvic acid, succinic acid and/or threonolactone. The invention discussed hereinafter relates in some embodiments to such transformed eukaryotic organisms.

It would also be advantageous if plants were available whose roots, leaves, stem, fruits or flowers produced large amounts of citramalic acid, glyceric acid, fumaric acid, malic acid, pyruvic acid, succinic acid and/or threonolactone. The invention discussed hereinafter relates in some embodiments to such transformed plants.

Therefore improving the quality of foodstuffs and animal feeds is an important task of the food-and-feed industry. It is further a task to increase the productivity of plants so that the content of citramalic acid, glyceric acid, fumaric acid, malic acid, pyruvic acid, succinic acid and/or threonolactone in the plants are increased. Said products can be isolated from the plants and used for the production of cosmetics and pharmaceuticals.

To ensure a high quality of foods, animal feeds, cosmetics and pharmaceuticals, it is therefore necessary to make the aforementioned compounds in safe plants.

Accordingly, there is still a great demand for new and more suitable genes which encode enzymes which participate in the biosynthesis of citramalic acid, glyceric acid, fumaric acid, malic acid, pyruvic acid, succinic acid and/or threonolactone, and make it possible to produce them specifically on an industrial scale without unwanted byproducts forming. In the selection of genes for biosynthesis two characteristics above all are particularly important. On the one hand, there is as ever a need for improved processes for obtaining the highest possible contents of said compounds; on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is citramalic acid, glyceric acid, fumaric acid, malic acid, pyruvic acid, succinic acid and/or threonolactone or their salts, amides, thioesters or esters. Accordingly, in the present invention, the term "the fine chemical" as used herein relates to "citramalic acid, glyceric acid, fumaric acid, malic acid, pyruvic acid, succinic acid and/or threonolactone or their salts, amides, thioesters or esters". Further, the term "the fine chemicals" as used herein also relates to fine chemicals comprising citramalic acid, glyceric acid, fumaric acid, malic acid, pyruvic acid, succinic acid and/or threonolactone or their salts, amides, thioesters or esters.

In one embodiment, the term "citramalic acid, glyceric acid, fumaric acid, malic acid, pyruvic acid, succinic acid and/or threonolactone or their salts, amides, thioesters or esters", "the fine chemical" or "the respective fine chemical" means at least one chemical compound selected from the group consisting of citramalic acid, glyceric acid, fumaric acid, malic acid, pyruvic acid, succinic acid and/or threonolactone or their salts, amides, thioesters or esters. Throughout the specification the term "the fine chemical" or "the respective fine chemical" means a compound selected from the group consisting of citramalic acid, glyceric acid, fumaric acid, malic acid, pyruvic acid, succinic acid and/or threonolactone or their salts, amides, thioesters or esters in free form or bound to other compounds such as proteins.

In one embodiment, the term "the fine chemical" and the term "the respective fine chemical" mean at least one chemical compound with an activity of the abovementioned fine chemical.

In one embodiment, the term "the fine chemical" or "the respective fine chemical" means a citramalic acid, its salts, amides, thioesters and/or esters.

In one embodiment, the term "the fine chemical" or "the respective fine chemical" means a glyceric acid, its salts, amides, thioesters and/or esters.

In another embodiment, the term "the fine chemical" or "the respective fine chemical" means fumaric acid, its salts, amides, thioesters and/or esters. In one embodiment, the term "the fine chemical" or "the respective fine chemical" means malic acid, its salts, amides, thioesters and/or esters. In further another embodiment, the term "the fine chemical" or "the respective fine chemical" means pyruvic acid, its salts, amides, thioesters and/or esters. In one embodiment, the term "the fine chemical" or "the respective fine chemical" means succinic acid, its salts, amides, thioesters and/or esters. In one embodiment, the term "the fine chemical" or "the respective fine chemical" means threonolactone. Throughout the specification the term "the fine chemical" or "the respective fine chemical" means citramalic acid, glyceric acid, fumaric acid, malic acid, pyruvic acid, succinic acid and/or threonolactone or their salts, amides, thioesters or esters in free form or bound to other compounds such as proteins, lipids or sugars or sugar polymers, like glucoside, e.g. diglucoside.

In particular it is known to the skilled that anionic compounds as acids are present in an equilibrium of the acid and its salts according to the pH present in the respective compartment of the cell or organism and the pK of the acid. Thus, the term "the fine chemical", the term "the respective fine chemical", the term "acid" or the use of a denomination referring to a neutralized anionic compound respectively relates the anionic form as well as the neutralised status of that compound.

Thus, citramalic acid relates also to citramalate, glyceric acid also relates to glycerate, fumaric acid also relates to fumarate, malic acid also relates to malate, pyruvic acid also relates to pyruvate, succinic acid relates to succinate.

In one embodiment, the term "the fine chemical" and the term "the respective fine chemical" mean at least one chemical compound with an activity of the above mentioned fine chemical Accordingly, the present invention relates to a process for the production of citramalic acid, glyceric acid, fumaric acid, malic acid, pyruvic acid, succinic acid and/or threonolactone, their salts, amides, thioesters and/or esters, which comprises (a) increasing or generating the activity of a protein as shown in table II, application no. 16, column 3 encoded by the nucleic acid sequences as shown in table I, application no. 16, column 5, in an organelle of a microorganism or plant, or (b) increasing or generating the activity of a protein as shown in table II, application no. 16, column 3 encoded by the nucleic acid sequences as shown in table I, application no. 16, column 5 in the plastid of a microorganism or plant, or in one or more parts thereof; and (c) growing the organism under conditions which permit the production of the fine chemical, thus, citramalic acid, glyceric acid, fumaric acid, malic acid, pyruvic acid, succinic acid and/or threonolactone, their salts, amides, thioesters and/or esters or fine chemicals comprising citramalic acid, glyceric acid, fumaric acid, malic acid, pyruvic acid, succinic acid and/or threonolactone, their salts, amides, thioesters and/or esters, are produced in said organism or in the culture medium surrounding the organism.

Accordingly, the term "the fine chemical" means "citramalic acid, glyceric acid, fumaric acid, malic acid, pyruvic acid, succinic acid and/or threonolactone, their salts, amides, thioesters and/or esters" in relation to all sequences listed in table I-IV, application no. 16, columns 3, 5 and 7 or homologs thereof. Accordingly, the term "the fine chemical" can mean "citramalic acid, glyceric acid, fumaric acid, malic acid, pyruvic acid, succinic acid and/or threonolactone, their salts, amides, thioesters and/or esters", owing to circumstances and the context. Preferably the term "the fine chemical" means "citramalic acid, glyceric acid, fumaric acid, malic acid, pyruvic acid, succinic acid and/or threonolactone or their salts". In order to illustrate that the meaning of the term "the respective fine chemical" means "citramalic acid, glyceric acid, fumaric acid, malic acid, pyruvic acid, succinic acid and/or threonolactone, their salts, amides, thioesters and/or esters" owing to the sequences listed in the context the term "the respective fine chemical" is also used.

In another embodiment the present invention is related to a process for the production of citramalic acid, glyceric acid, fumaric acid, malic acid, pyruvic acid, succinic acid and/or threonolactone, their salts, amides, thioesters and/or esters, which comprises (a) increasing or generating the activity of a protein as shown in table II, application no. 16, column 3 encoded by the nucleic acid sequences as shown in table I, application no. 16, column 5, in an organelle of a non-human organism, or (b) increasing or generating the activity of a protein as shown in table II, application no. 16, column 3 encoded by the nucleic acid sequences as shown in table I, application no. 16, column 5, which are joined to a nucleic acid sequence encoding a transit peptide in a non-human organism, or in one or more parts thereof; or (c) increasing or generating the activity of a protein as shown in table II, application no. 16, column 3 encoded by the nucleic acid sequences as shown in table I, application no. 16, column 5, which are joined to a nucleic acid sequence encoding chloroplast localization sequence, in a non-human organism, or in one or more parts thereof, and (d) growing the organism under conditions which permit the production of citramalic acid, glyceric acid, fumaric acid, malic acid, pyruvic acid, succinic acid and/or threonolactone, their salts, amides, thioesters and/or esters in said organism.

In another embodiment, the present invention relates to a process for the production of citramalic acid, glyceric acid, fumaric acid, malic acid, pyruvic acid, succinic acid and/or threonolactone, their salts, amides, thioesters and/or esters, which comprises (a) increasing or generating the activity of a protein as shown in table II, application no. 16, column 3 encoded by the nucleic acid sequences as shown in table I, application no. 16, column 5, in an organelle of a microorganism or plant through the transformation of the organelle, or (b) increasing or generating the activity of a protein as shown in table II, application no. 16, column 3 encoded by the nucleic acid sequences as shown in table I, application no. 16, column 5 in the plastid of a microorganism or plant, or in one or more parts thereof through the transformation of the plastids; and (c) growing the organism under conditions which permit the production of the fine chemical, thus, citramalic acid, glyceric acid, fumaric acid, malic acid, pyruvic acid, succinic acid and/or threonolactone, their salts, amides, thioesters and/or esters or fine chemicals comprising citramalic acid, glyceric acid, fumaric acid, malic acid, pyruvic acid, succinic acid and/or threonolactone, their salts, amides, thioesters and/or esters, are produced in said organism or in the culture medium surrounding the organism.

Advantagously the activity of the protein as shown in table II, application no. 16, column 3 encoded by the nucleic acid sequences as shown in table I, application no. 16, column 5 is increased or generated in the abovementioned process in the plastid of a microorganism or plant.

for the disclosure of the paragraphs [0019.0.0.15] to [0024.0.0.15] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 16, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 16, column 3 and its homologs as disclosed in table I, application no. 16, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 16, column 3 and its homologs as disclosed in table I, application no. 16, columns 5 and 7.

for the disclosure of the paragraphs [0027.0.0.15] to [0029.0.0.15] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 16, columns 5 and 7. The person skilled in the art is able to join said sequences in a functional manner. Advantageously the transit peptide part is cleaved off from the protein part shown in table II, application no. 16, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 16, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 16, columns 5 and 7. In case of the amino acid sequence QIA CSS the three amino acids in front of the start methionine are stemming from the LIC (=ligation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 16, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 16, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 16, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.15] and [0030.3.0.15] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 16, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 16, columns 5 and 7 or a sequence encoding a protein, as depicted in table II, application no. 16, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 16, columns 5 and 7 or a sequence encoding a protein, as depicted in table II, application no. 16, columns 5 and 7 in such a manner that the viroid sequence transports a sequence transcribed from a sequence as depicted in table I, application no. 16, columns 5 and 7 or a sequence encoding a protein as depicted in table II, application no. 16, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 16, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 16, columns 5 and 7.

In a preferred embodiment of the invention the nucleic acid sequences as shown in table I, application no. 16, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 16, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.15] and [0032.0.0.15] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 16, column 3. Preferably the modification of the activity of a protein as shown in table II, application no. 16, column 3 or their combination can be achieved by joining the protein to a transit peptide.

Surprisingly it was found, that the transgenic expression of the *Escherichia coli* or *Saccaromyces cerevisiae* protein as shown in table II, application no. 16, column 3 in plastids of a plant such as *Arabidopsis thalaiana* for example through the linkage to at least one targeting sequence for example as mentioned in table V conferred an increase in the fine chemical content of the transformed plants as shown in any one of table I-IV application no. 16, column 6.

for the disclosure of this paragraph see paragraph [0035.0.0.0] above.

The sequence of b0931 (Accession number PIR:JQ0756) from *Escherichia coli* has been published in Blattner et al., Science 277 (5331), 1453-1474 (1997), and its activity is being defined as "nicotinate phosphoribosyltransferase". Accordingly, in one embodiment, the process of the present invention comprises the use of a "nicotinate phosphoribosyltransferase" or its homolog, e.g. as shown herein, for the production of the fine chemical, meaning of fumaric acid, its salts, amides, thioesters or esters, in particular for increasing the amount of fumaric acid, its salts, amides, thioesters or esters in free or bound form in an organism or a part thereof, as mentioned. In one embodiment, in the process of the present invention the activity of a b0931 protein is increased or generated, e.g. from *Escherichia coli* or a homolog thereof, preferably linked at least to one transit peptide as mentioned for example in table V.

In another embodiment, in the process of the present invention the activity of a b0931 protein is increased or generated in a subcellular compartment of the organism or organism cell such as in an organelle like a plastid or mitochondria.

The sequence of b1046 (Accession number PIR:C64847) from *Escherichia coli* has been published in Blattner et al., Science 277 (5331), 1453-1474 (1997), and its activity is being defined as "putative synthase with phospholipase D/nuclease domain". Accordingly, in one embodiment, the process of the present invention comprises the use of a "putative synthase with phospholipase D/nuclease domain" or its homolog, e.g. as shown herein, for the production of the fine chemical, meaning of glyceric acid, its salts, amides, thioesters or esters, in particular for increasing the amount of glyceric acid, its salts, amides, thioesters or esters in free or bound form in an organism or a part thereof, as mentioned. In one embodiment, in the process of the present invention the activity of a b1046 protein is increased or generated, e.g. from *Escherichia coli* or a homolog thereof, preferably linked at least to one transit peptide as mentioned for example in table V.

In another embodiment, in the process of the present invention the activity of a b1046 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of fumaric acid, its salts, amides, thioesters or esters, in particular for increasing the amount of fumaric acid, its salts, amides, thioesters or esters in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of succinic acid, its salts, amides, thioesters or esters, in particular for increasing the amount of succinic acid, its salts, amides, thioesters or esters in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of threonolactone, in particular for increasing the amount of threonolactone in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria. Furthermore in one embodiment, the process of the present invention comprises the use of a "Qin prohage" or its homolog, e.g. as shown herein for the production of the fine chemicals, in particular for increasing the amount of one or of any combination of 2, 3 of the fine chemicals, e.g. compounds, selected from the group of "fumaric acid, succinic acid and threolactone.

The sequence of b1732 (Accession number PIR:A39129) from *Escherichia coli* has been published in Blattner et al., Science 277 (5331), 1453-1474 (1997), and its activity is being defined as "catalase (hydroperoxidase), RpoS-dependent". Accordingly, in one embodiment, the process of the present invention comprises the use of a "catalase (hydroperoxidase), RpoS-dependent" or its homolog, e.g. as shown herein, for the production of the fine chemical, meaning of succinic acid, its salts, amides, thioesters or esters, in particular for increasing the amount of succinic acid, its salts, amides, thioesters or esters in free or bound form in an organism or a part thereof, as mentioned. In one embodiment, in the process of the present invention the activity of a b1732 protein is increased or generated, e.g. from *Escherichia coli* or a homolog thereof, preferably linked at least to one transit peptide as mentioned for example in table V.

In another embodiment, in the process of the present invention the activity of a b1732 protein is increased or generated in a subcellular compartment of the organism or organism cell such as in an organelle like a plastid or mitochondria.

The sequence of b2066 (Accession number NP_416570) from *Escherichia coli* has been published in Blattner et al., Science 277 (5331), 1453-1474 (1997), and its activity is being defined as "uridine/cytidine kinase". Accordingly, in one embodiment, the process of the present invention comprises the use of a "uridine/cytidine kinase" or its homolog, e.g. as shown herein, for the production of the fine chemical, meaning of malic acid, its salts, amides, thioesters or esters, in particular for increasing the amount of malic acid, its salts, amides, thioesters or esters in free or bound form in an organism or a part thereof, as mentioned. In one embodiment, in the process of the present invention the activity of a b2066 protein is increased or generated, e.g. from *Escherichia coli* or a homolog thereof, preferably linked at least to one transit peptide as mentioned for example in table V.

In another embodiment, in the process of the present invention the activity of a b2066 protein is increased or generated in a subcellular compartment of the organism or organism cell such as in an organelle like a plastid or mitochondria.

The sequence of b2312 (Accession number PIR:XQEC) from *Escherichia coli* has been published in Blattner et al., Science 277 (5331), 1453-1474 (1997), and its activity is being defined as "amidophosphoribosyltransferase (PRPP amidotransferase)". Accordingly, in one embodiment, the process of the present invention comprises the use of a "amidophosphoribosyltransferase (PRPP amidotransferase)" or its homolog, e.g. as shown herein, for the production of the fine chemical, meaning of succinic acid, its salts, amides, thioesters or esters, in particular for increasing the amount of succinic acid, its salts, amides, thioesters or esters in free or bound form in an organism or a part thereof, as mentioned. In one embodiment, in the process of the present invention the activity of a b2312 protein is increased or generated, e.g. from *Escherichia coli* or a homolog thereof, preferably linked at least to one transit peptide as mentioned for example in table V.

In another embodiment, in the process of the present invention the activity of a b2312 protein is increased or generated in a subcellular compartment of the organism or organism cell such as in an organelle like a plastid or mitochondria.

The sequence of b3770 (Accession number YP_026247) from *Escherichia coli* has been published in Blattner et al., Science 277 (5331), 1453-1474 (1997), and its activity is being defined as "branched-chain amino-acid aminotransferase". Accordingly, in one embodiment, the process of the present invention comprises the use of a "branched-chain amino-acid aminotransferase" or its homolog, e.g. as shown herein, for the production of the fine chemical, meaning of citramalic acid, its salts, amides, thioesters or esters, in particular for increasing the amount of citramalic acid, its salts, amides, thioesters or esters in free or bound form in an organism or a part thereof, as mentioned. In one embodiment, in the process of the present invention the activity of a b3770 protein is increased or generated, e.g. from *Escherichia coli* or a homolog thereof, preferably linked at least to one transit peptide as mentioned for example in table V.

In another embodiment, in the process of the present invention the activity of a b3770 protein is increased or generated in a subcellular compartment of the organism or organism cell such as in an organelle like a plastid or mitochondria.

The sequence of b4122 (Accession number PIR:B44511) from *Escherichia coli* has been published in Blattner et al., Science 277 (5331), 1453-1474 (1997), and its activity is being defined as "fumarase B, fumarate hydratase Class I". Accordingly, in one embodiment, the process of the present invention comprises the use of a "fumarase B, fumarate hydratase Class I" or its homolog, e.g. as shown herein, for the production of the fine chemical, meaning of fumaric acid, its salts, amides, thioesters or esters, in particular for increasing the amount of fumaric acid, its salts, amides, thioesters or esters in free or bound form in an organism or a part thereof, as mentioned. In one embodiment, in the process of the present invention the activity of a b4122 protein is increased or generated, e.g. from *Escherichia coli* or a homolog thereof, preferably linked at least to one transit peptide as mentioned for example in table V.

In another embodiment, in the process of the present invention the activity of a b4122 protein is increased or generated in a subcellular compartment of the organism or organism cell such as in an organelle like a plastid or mitochondria.

The sequence of b4139 (Accession number NP_418562) from *Escherichia coli* has been published in Blattner et al., Science 277 (5331), 1453-1474 (1997), and its activity is being defined as "aspartate ammonia-lyase (aspartase)". Accordingly, in one embodiment, the process of the present invention comprises the use of a "aspartate ammonia-lyase (aspartase)" or its homolog, e.g. as shown herein, for the production of the fine chemical, meaning of fumaric acid, its salts, amides, thioesters or esters, in particular for increasing the amount of fumaric acid, its salts, amides, thioesters or esters in free or bound form in an organism or a part thereof, as mentioned. In one embodiment, in the process of the present invention the activity of a b4139 protein is increased or generated, e.g. from *Escherichia coli* or a homolog thereof, preferably linked at least to one transit peptide as mentioned for example in table V.

In another embodiment, in the process of the present invention the activity of a b4139 protein is increased or generated in a subcellular compartment of the organism or organism cell such as in an organelle like a plastid or mitochondria.

The sequence of YAL038W (Accession number NP_009362) from *Saccharomyces cerevisiae* has been published in Goffeau et al., Science 274 (5287), 546-547, 1996, and its activity is being defined as "pyruvate kinase". Accordingly, in one embodiment, the process of the present invention comprises the use of a "pyruvate kinase" or its homolog, e.g. as shown herein, for the production of the fine chemical, meaning of succinic acid, its salts, amides, thioesters or esters, in particular for increasing the amount of succinic acid, its salts, amides, thioesters or esters in free or bound form in an organism or a part thereof, as mentioned. In one embodiment, in the process of the present invention the activity of a YAL038W protein is increased or generated, e.g. from *Escherichia coli* or a homolog thereof, preferably linked at least to one transit peptide as mentioned for example in table V.

In another embodiment, in the process of the present invention the activity of a YAL038W protein is increased or generated in a subcellular compartment of the organism or organism cell such as in an organelle like a plastid or mitochondria.

The sequence of YAL038W (Accession number NP_009362) from *Saccharomyces cerevisiae* has been published in Goffeau et al., Science 274 (5287), 546-547, 1996, and its activity is being defined as "pyruvate kinase". Accordingly, in one embodiment, the process of the present invention comprises the use of a "pyruvate kinase" or its homolog, e.g. as shown herein, for the production of the fine chemical, meaning of pyruvic acid, its salts, amides, thioesters or esters, in particular for increasing the amount of pyruvic acid, its salts, amides, thioesters or esters in free or bound form in an organism or a part thereof, as mentioned. In one embodiment, in the process of the present invention the activity of a YAL038W protein is increased or generated, e.g. from *Escherichia coli* or a homolog thereof, preferably linked at least to one transit peptide as mentioned for example in table V.

In another embodiment, in the process of the present invention the activity of a YAL038W protein is increased or generated in a subcellular compartment of the organism or organism cell such as in an organelle like a plastid or mitochondria.

The sequence of YAL038W (Accession number NP_009362) from *Saccharomyces cerevisiae* has been published in Goffeau et al., Science 274 (5287), 546-547, 1996, and its activity is being defined as "pyruvate kinase". Accordingly, in one embodiment, the process of the present invention comprises the use of a "pyruvate kinase" or its homolog, e.g. as shown herein, for the production of the fine chemical, meaning of citramalic acid, its salts, amides, thioesters or esters, in particular for increasing the amount of citramalic acid, its salts, amides, thioesters or esters in free or bound form in an organism or a part thereof, as mentioned. In one embodiment, in the process of the present invention the activity of a YAL038W protein is increased or generated, e.g. from *Escherichia coli* or a homolog thereof, preferably linked at least to one transit peptide as mentioned for example in table V.

In another embodiment, in the process of the present invention the activity of a YAL038W protein is increased or generated in a subcellular compartment of the organism or organism cell such as in an organelle like a plastid or mitochondria. Furthermore in one embodiment, the process of the present invention comprises the use of a "pyruvate kinase" or its homolog, e.g. as shown herein for the production of the fine chemicals, in particular for increasing the amount of one or of any combination of 2, 3 of the fine chemicals, e.g. compounds, selected from the group of "citramalic acid, succinic acid and pyruvic acid.

The sequence of YDL078C (Accession number PIR:D-EBYMP) from *Saccharomyces cerevisiae* has been published in Jacq et al., Nature 387 (6632 Suppl), 75-78, 1997, and its activity is being defined as "malate dehydrogenase". Accordingly, in one embodiment, the process of the present invention comprises the use of a "malate dehydrogenase" or its homolog, e.g. as shown herein, for the production of the fine chemical, meaning of malic acid, its salts, amides, thioesters or esters, in particular for increasing the amount of malic acid, its salts, amides, thioesters or esters in free or bound form in an organism or a part thereof, as mentioned. In one embodiment, in the process of the present invention the activity of a YDL078C protein is increased or generated, e.g. from *Escherichia coli* or a homolog thereof, preferably linked at least to one transit peptide as mentioned for example in table V.

In another embodiment, in the process of the present invention the activity of a YDL078C protein is increased or generated in a subcellular compartment of the organism or organism cell such as in an organelle like a plastid or mitochondria.

The sequence of YGL065C (Accession number PIR: S64069) from *Saccharomyces cerevisiae* has been published in Jackson et al., Glycobiology, 3:357-364(1993), and its activity is being defined as "ALG2 protein precursor". Accordingly, in one embodiment, the process of the present invention comprises the use of a "ALG2 protein precursor" or its homolog, e.g. as shown herein, for the production of the fine chemical, meaning of succinic acid, its salts, amides, thioesters or esters, in particular for increasing the amount of succinic acid, its salts, amides, thioesters or esters in free or bound form in an organism or a part thereof, as mentioned. In one embodiment, in the process of the present invention the activity of a YGL065C protein is increased or generated, e.g. from *Escherichia coli* or a homolog thereof, preferably linked at least to one transit peptide as mentioned for example in table V.

In another embodiment, in the process of the present invention the activity of a YGL065C protein is increased or generated in a subcellular compartment of the organism or organism cell such as in an organelle like a plastid or mitochondria.

The sequence of YGL126W (Accession number NP_011389) from *Saccharomyces cerevisiae* has been published in Goffeau et al., Science 274 (5287), 546-547, 1996, and its activity is being defined as "protein, which is required for inositol prototrophy".

Accordingly, in one embodiment, the process of the present invention comprises the use of a "protein, which is required for inositol prototrophy" or its homolog, e.g. as shown herein, for the production of the fine chemical, meaning of succinic acid, its salts, amides, thioesters or esters, in particular for increasing the amount of succinic acid, its salts, amides, thioesters or esters in free or bound form in an organism or a part thereof, as mentioned. In one embodiment, in the process of the present invention the activity of a YGL126W protein is increased or generated, e.g. from *Escherichia coli* or a homolog thereof, preferably linked at least to one transit peptide as mentioned for example in table V.

In another embodiment, in the process of the present invention the activity of a YGL126W protein is increased or generated in a subcellular compartment of the organism or organism cell such as in an organelle like a plastid or mitochondria.

The sequence of YJL139C (Accession number PIR: S36856) from *Saccharomyces cerevisiae* has been published in Foreman et al., Nucleic Acids Res. 19:2781-2781(1991), and its activity is being defined as "mannosyltransferase of the KTR1 family, involved in protein N-glycosylation". Accordingly, in one embodiment, the process of the present invention comprises the use of a "mannosyltransferase of the KTR1 family, involved in protein N-glycosylation" or its homolog, e.g. as shown herein, for the production of the fine chemical, meaning of fumaric acid, its salts, amides, thioesters or esters, in particular for increasing the amount of fumaric acid, its salts, amides, thioesters or esters in free or bound form in an organism or a part thereof, as mentioned. In one embodiment, in the process of the present invention the activity of a YJL139C protein is increased or generated, e.g. from *Escherichia coli* or a homolog thereof, preferably linked at least to one transit peptide as mentioned for example in table V.

In another embodiment, in the process of the present invention the activity of a YJL139C protein is increased or generated in a subcellular compartment of the organism or organism cell such as in an organelle like a plastid or mitochondria.

The sequence of YKR043C (Accession number NP_012969) from *Saccharomyces cerevisiae* has been published in Goffeau et al., Science 274 (5287), 546-547, 1996, and its activity is being defined as "phosphoglycerate mutase like protein". Accordingly, in one embodiment, the process of the present invention comprises the use of a "phosphoglycerate mutase like protein" or its homolog, e.g. as shown herein, for the production of the fine chemical, meaning of malic acid, its salts, amides, thioesters or esters, in particular for increasing the amount of malic acid, its salts, amides, thioesters or esters in free or bound form in an organism or a part thereof, as mentioned. In one embodiment, in the process of the present invention the activity of a YKR043C protein is increased or generated, e.g. from *Escherichia coli* or a homolog thereof, preferably linked at least to one transit peptide as mentioned for example in table V.

In another embodiment, in the process of the present invention the activity of a YKR043C protein is increased or generated in a subcellular compartment of the organism or organism cell such as in an organelle like a plastid or mitochondria.

The sequence of YKR043C (Accession number NP_012969) from *Saccharomyces cerevisiae* has been published in Goffeau et al., Science 274 (5287), 546-547, 1996, and its activity is being defined as "phosphoglycerate mutase like protein". Accordingly, in one embodiment, the process of the present invention comprises the use of a "phosphoglycerate mutase like protein" or its homolog, e.g. as shown herein, for the production of the fine chemical, meaning of fumaric acid, its salts, amides, thioesters or esters, in particular for increasing the amount of fumaric acid, its salts, amides, thioesters or esters in free or bound form in an organism or a part thereof, as mentioned. In one embodiment, in the process of the present invention the activity of a YKR043C protein is increased or generated, e.g. from *Escherichia coli* or a homolog thereof, preferably linked at least to one transit peptide as mentioned for example in table V.

In another embodiment, in the process of the present invention the activity of a YKR043C protein is increased or generated in a subcellular compartment of the organism or organism cell such as in an organelle like a plastid or mitochondria. Furthermore in one embodiment, the process of the present invention comprises the use of a "phosphoglycerate mutase like protein" or its homolog, e.g. as shown herein for the production of the fine chemicals, in particular for increasing the amount of fumaric acid, its salts, amides, thioesters or esters and malic acid, its salts, amides, thioesters or esters.

The sequence of YOL126C (Accession number PIR:DEBYMC) from *Saccharomyces cerevisiae* has been published in Minard K. I., McAlister-Henn L., Mol. Cell. Biol. 11:370-380(1991), and its activity is being defined as "malate dehydrogenase". Accordingly, in one embodiment, the process of the present invention comprises the use of a "malate dehydrogenase" or its homolog, e.g. as shown herein, for the production of the fine chemical, meaning of fumaric acid, its salts, amides, thioesters or esters, in particular for increasing the amount of fumaric acid, its salts, amides, thioesters or esters in free or bound form in an organism or a part thereof, as mentioned. In one embodiment, in the process of the present invention the activity of a YOL126C protein is increased or generated, e.g. from *Escherichia coli* or a homolog thereof, preferably linked at least to one transit peptide as mentioned for example in table V.

In another embodiment, in the process of the present invention the activity of a YOL126C protein is increased or generated in a subcellular compartment of the organism or organism cell such as in an organelle like a plastid or mitochondria. The sequence of YOL126C (Accession number PIR:DEBYMC) from *Saccharomyces cerevisiae* has been published in Minard K. I., McAlister-Henn L., Mol. Cell. Biol. 11:370-380(1991), and its activity is being defined as "malate dehydrogenase". Accordingly, in one embodiment, the process of the present invention comprises the use of a "malate dehydrogenase" or its homolog, e.g. as shown herein, for the production of the fine chemical, meaning of malic acid, its salts, amides, thioesters or esters, in particular for increasing the amount of malic acid, its salts, amides, thioesters or esters in free or bound form in an organism or a part thereof, as mentioned. In one embodiment, in the process of the present invention the activity of a YOL126C protein is increased or generated, e.g. from *Escherichia coli* or a homolog thereof, preferably linked at least to one transit peptide as mentioned for example in table V.

In another embodiment, in the process of the present invention the activity of a YOL126C protein is increased or generated in a subcellular compartment of the organism or organism cell such as in an organelle like a plastid or mitochondria. Furthermore in one embodiment, the process of the present invention comprises the use of a "malate dehydrogenase" or its homolog, e.g. as shown herein for the production of the fine chemicals, in particular for increasing the amount of fumaric acid, its salts, amides, thioesters or esters and malic acid, its salts, amides, thioesters or esters. The sequence of YOR350C (Accession number PIR|S67259) from *Saccharomyces cerevisiae* has been published in Dujon et al., Nature 387:98-102(1997), and its activity is being defined as "a protein, which is similar to *Lucilia illustris* mitochondria cytochrome oxidase". Accordingly, in one embodiment, the process of the present invention comprises the use of a "protein, which is similar to *Lucilia illustris* mitochondria cytochrome oxidase" or its homolog, e.g. as shown herein, for the production of the fine chemical, meaning of glyceric acid, its salts, amides, thioesters or esters, in particular for increasing the amount of glyceric acid, its salts, amides, thioesters or esters in free or bound form in an organism or a part thereof, as mentioned. In one embodiment, in the process of the present invention the activity of a YOR350C protein is increased or generated, e.g. from *Escherichia coli* or a homolog thereof, preferably linked at least to one transit peptide as mentioned for example in table V.

In another embodiment, in the process of the present invention the activity of a YOR350C protein is increased or generated in a subcellular compartment of the organism or organism cell such as in an organelle like a plastid or mitochondria.

In one embodiment, the homolog of the YAL038W, YAL038W, YAL038W, YDL078C, YGL065C, YGL126W, YJL139C, YKR043C, YKR043C, YOL126C, YOL126C or YOR350C, is a homolog having said activity and being derived from Eukaryot. In one embodiment, the homolog of the b0931, b1046, b1556, b1556, b1556, b1732, b2066, b2312, b3770, b4122 or b4139 is a homolog having said activity and being derived from bacteria. In one embodiment, the homolog of the YAL038W, YAL038W, YAL038W, YDL078C, YGL065C, YGL126W, YJL139C, YKR043C, YKR043C, YOL126C, YOL126C or YOR350C is a homolog having said activity and being derived from Fungi. In one embodiment, the homolog of the b0931, b1046, b1556, b1556, b1556, b1732, b2066, b2312, b3770, b4122 or b4139 is a homolog having said activity and being derived from Proteobacteria. In one embodiment, the homolog of the YAL038W, YAL038W, YAL038W, YDL078C, YGL065C, YGL126W, YJL139C, YKR043C, YKR043C, YOL126C, YOL126C or YOR350C is a homolog having said activity and being derived from Ascomycota. In one embodiment, the homolog of the b0931, b1046, b1556, b1556, b1556, b1732, b2066, b2312, b3770, b4122 or b4139 is a homolog having said activity and being derived from Gammaproteobacteria. In one embodiment, the homolog of the YAL038W, YAL038W, YAL038W, YDL078C, YGL065C, YGL126W, YJL139C, YKR043C, YKR043C, YOL126C, YOL126C or YOR350C is a homolog having said activity and being derived from *Saccharomycotina*. In one embodiment, the homolog of the b0931, b1046, b1556, b1556, b1556, b1732, b2066, b2312, b3770, b4122 or b4139 is a homolog having said activity and being derived from Enterobacteriales. In one embodiment, the homolog of the YAL038W, YAL038W, YAL038W, YDL078C, YGL065C, YGL126W, YJL139C, YKR043C, YKR043C, YOL126C, YOL126C or YOR350C is a homolog having said activity and being derived from *Saccharomycetes*. In one embodiment, the homolog of the b0931, b1046, b1556, b1556, b1556, b1732, b2066, b2312, b3770, b4122 or b4139 is a homolog having said activity and being derived from Enterobacteriaceae. In one embodiment, the homolog of the YAL038W, YAL038W, YAL038W, YDL078C, YGL065C, YGL126W, YJL139C, YKR043C, YKR043C, YOL126C, YOL126C or YOR350C is a homolog having said activity and being derived from *Saccharomycetales*. In one embodiment, the homolog of the b0931, b1046, b1556, b1556, b1556, b1732, b2066, b2312, b3770, b4122 or b4139 is a homolog having said activity and being derived from *Escherichia*, preferably from *Escherichia coli*. In one embodiment, the homolog of the YAL038W, YAL038W, YAL038W, YDL078C, YGL065C, YGL126W, YJL139C, YKR043C, YKR043C, YOL126C, YOL126C or YOR350C is a homolog having said activity and being derived from Saccharomycetaceae. In one embodiment, the homolog of the YAL038W, YAL038W, YAL038W, YDL078C, YGL065C, YGL126W, YJL139C, YKR043C, YKR043C, YOL126C, YOL126C or YOR350C is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II, application no. 16, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 16, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 16, column 3, or which has at least 10% of the original enzymatic activity, preferably 20%, particularly preferably 30%, most particularly preferably 40% in comparison to a protein as shown in table II, application no. 16, column 3 of *Saccharomyces cerevisiae*.

for the disclosure of the paragraphs [0040.0.0.15] to [0047.0.0.15] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 16, column 3 its biochemical or genetical causes and the increased amount of the fine chemical.

for the disclosure of the paragraphs [0049.0.0.15] to [0051.0.0.15] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 16, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.15] to [0058.0.0.15] see paragraphs [0053.0.0.0] to [0058.0.0.0] above.

In case the activity of the *Escherichia coli* protein b0931 or its homologs, e.g. a "nicotinate phosphoribosyltransferase" is increased advantageously in an organelle such as a plastid or mitochondria, preferably, in one embodiment an increase of the fine chemical, preferably of fumaric acid, its salts, amides, thioesters and/or esters between 47% and 365% or more is conferred.

In case the activity of the *Escherichia coli* protein b1046 or its homologs, e.g. a "putative synthase with phospholipase D/nuclease domain" is increased advantageously in an organelle such as a plastid or mitochondria, preferably, in one embodiment an increase of the fine chemical, preferably of glyceric acid, its salts, amides, thioesters and/or esters between 31% and 65% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of fumaric acid, its salts, amides, thioesters and/or esters between 136% and 372% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of succinic acid, its salts, amides, thioesters and/or esters between 47% and 204% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of threonolactone between 38% and 103% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of fumaric acid, its salts, amides, thioesters and/or esters between 136% and 372% or more and/or succinic acid, its salts, amides, thioesters and/or esters between 47% and 204% or more and/or of threonolactone between 38% and 103% or more is conferred.

In case the activity of the *Escherichia coli* protein b1732 or its homologs, e.g. a "catalase (hydroperoxidase), RpoS-dependent" is increased advantageously in an organelle such as a plastid or mitochondria, preferably, in one embodiment an increase of the fine chemical, preferably of succinic acid, its salts, amides, thioesters and/or esters between 28% and 37% or more is conferred.

In case the activity of the *Escherichia coli* protein b2066 or its homologs, e.g. a "uridine/cytidine kinase" is increased advantageously in an organelle such as a plastid or mitochondria, preferably, in one embodiment an increase of the fine chemical, preferably of malic acid, their salts, amides, thioesters and/or esters between 70% and 292% or more is conferred.

In case the activity of the *Escherichia coli* protein b2312 or its homologs, e.g. a "amidophosphoribosyltransferase (PRPP amidotransferase)" is increased advantageously in an organelle such as a plastid or mitochondria, preferably, in one embodiment an increase of the fine chemical, preferably of succinic acid, their salts, amides, thioesters and/or esters between 24% and 33% or more is conferred.

In case the activity of the *Escherichia coli* protein 3770 or its homologs, e.g. a "branched-chain amino-acid aminotransferase" is increased advantageously in an organelle such as a plastid or mitochondria, preferably, in one embodiment an increase of the fine chemical, preferably of citramalic acid, their salts, amides, thioesters and/or esters between 49% and 223% or more is conferred.

In case the activity of the *Escherichia coli* protein b4122 or its homologs, e.g. a "fumarase B, fumarate hydratase Class I" is increased advantageously in an organelle such as a plastid or mitochondria, preferably, in one embodiment an increase of the fine chemical, preferably of fumaric acid, their salts, amides, thioesters and/or esters between 153% and 444% or more is conferred.

In case the activity of the *Escherichia coli* protein b4139 or its homologs, e.g. a "aspartate ammonia-lyase (aspartase)" is increased advantageously in an organelle such as a plastid or mitochondria, preferably, in one embodiment an increase of the fine chemical, preferably of fumaric acid, their salts, amides, thioesters and/or esters between 1394% and 2437% or more is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably of succinic acid, their salts, amides, thioesters and/or esters between 40% and 367% or more is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably of pyruvic acid, their salts, amides, thioesters and/or esters between 37% and 164% or more is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably of citramalic acid, their salts, amides, thioesters and/or esters between 72% and 337% or more is conferred.

In case the activity of the *Saccharomyces cerevisiae* protein YAL038W or its homologs, e.g. a "pyruvate kinase" is increased advantageously in an organelle such as a plastid or mitochondria, preferably, in one embodiment an increase of the fine chemical, preferably of succinic acid, their salts, amides, thioesters and/or esters between 40% and 367% or more and/or pyruvic acid, their salts, amides, thioesters and/or esters between 37% and 164% or more and/or citramalic acid, their salts, amides, thioesters and/or esters between 72% and 337% or more is conferred.

In case the activity of the *Saccharomyces cerevisiae* protein YDL078C or its homologs, e.g. a "malate dehydrogenase" is increased advantageously in an organelle such as a plastid or mitochondria, preferably, in one embodiment an increase of the fine chemical, preferably of malic acid, their salts, amides, thioesters and/or esters between 83% and 371% or more is conferred.

In case the activity of the *Saccharomyces cerevisiae* protein YGL065C or its homologs, e.g. a "ALG2 protein precursor" is increased advantageously in an organelle such as a plastid or mitochondria, preferably, in one embodiment an increase of the fine chemical, preferably of succinic acid, their salts, amides, thioesters and/or esters between 8% and 21% or more is conferred.

In case the activity of the *Saccharomyces cerevisiae* protein YGL126W or its homologs, e.g. a "protein required for inositol prototrophy" is increased advantageously in an organelle such as a plastid or mitochondria, preferably, in one embodiment an increase of the fine chemical, preferably of succinic acid, their salts, amides, thioesters and/or esters between 30% and 45% or more is conferred.

In case the activity of the *Saccharomyces cerevisiae* protein YJL139C or its homologs, e.g. a "Mannosyltransferase of the KTR1 family, involved in protein N-glycosylation" is increased advantageously in an organelle such as a plastid or mitochondria, preferably, in one embodiment an increase of the fine chemical, preferably of fumaric acid, their salts, amides, thioesters and/or esters between 55% and 310% or more is conferred. In case the activity of the *Saccharomyces cerevisiae* protein YKR043C or its homologs, e.g. a "phosphoglycerate mutase like protein" is increased advantageously in an organelle such as a plastid or mitochondria, preferably, in one embodiment an increase of the fine chemical, preferably of malic acid, their salts, amides, thioesters and/or esters between 54% and 216% or more is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably, in one embodiment an increase of the fine chemical, preferably of fumaric acid, their salts, amides, thioesters and/or esters between 990% and 1435% or more is conferred.

In case the activity of the *Saccharomyces cerevisiae* protein YKR043C or its homologs, e.g. a "phosphoglycerate mutase like protein" is increased advantageously in an organelle such as a plastid or mitochondria, preferably, in one embodiment an increase of the fine chemical, preferably of malic acid, their salts, amides, thioesters and/or esters between 54% and 216% or more and/or fumaric acid, their salts, amides, thioesters and/or esters between 990% and 1435% or more is conferred.

In case the activity of the *Saccharomyces cerevisiae* protein YOL126C or its homologs, e.g. a "malate dehydrogenase" is increased advantageously in an organelle such as a plastid or mitochondria, preferably, in one embodiment an increase of the fine chemical, preferably of fumaric acid, their salts, amides, thioesters and/or esters between 100% and 118% or more is conferred.

In case the activity of the *Saccharomyces cerevisiae* protein YOL126C or its homologs, e.g. a "malate dehydrogenase" is increased advantageously in an organelle such as a plastid or mitochondria, preferably, in one embodiment an increase of the fine chemical, preferably of malic acid, their salts, amides, thioesters and/or esters between 83% and 204% or more is conferred.

In case the activity of the *Saccharomyces cerevisiae* protein YOL126C or its homologs, e.g. a "malate dehydrogenase" is increased advantageously in an organelle such as a plastid or mitochondria, preferably, in one embodiment an increase of the fine chemical, preferably of fumaric acid, their salts, amides, thioesters and/or esters between 100% and 118% or more and/or malic acid, their salts, amides, thioesters and/or esters between 83% and 204% or more is conferred.

In case the activity of the *Saccharomyces cerevisiae* protein YOR350C or its homologs, e.g. a "protein similar to *Lucilia illustris* mitochondria cytochrome oxidase" is increased advantageously in an organelle such as a plastid or mitochondria, preferably, in one embodiment an increase of the fine chemical, preferably of glyceric acid, their salts, amides, thioesters and/or esters between 41% and 51% or more is conferred.

In case the activity of the *Escherichia coli* proteins b0931, b1046, b1556, b1556, b1556, b1732, b2066, b2312, b3770, b4122 and/or b4139 or their homologs, are increased advantageously in an organelle such as a plastid or mitochondria, preferably an increase of the fine chemical such as citramalic acid, glyceric acid, fumaric acid, malic acid, pyruvic acid, succinic acid and/or threonolactone, their salts, amides, thioesters and/or esters is conferred.

In case the activity of the *Saccharomyces cerevisiae* proteins YAL038W, YAL038W, YAL038W, YDL078C, YGL065C, YGL126W, YJL139C, YKR043C, YKR043C, YOL126C, YOL126C and/or YOR350C or its homologs are increased advantageously in an organelle such as a plastid or mitochondria, preferably an increase of the fine chemical such as citramalic acid, glyceric acid, fumaric acid, malic acid, pyruvic acid, succinic acid and/or threonolactone, their salts, amides, thioesters and/or esters is conferred.

for the disclosure of the paragraphs [0061.0.0.15] and [0062.0.0.15] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 16, column 7 or of the polypeptide as shown in the amino acid sequences as disclosed in table II, application no. 16, columns 5 and 7 or the functional homologues thereof as described herein, or is encoded by the nucleic acid molecule characterized herein or the nucleic acid molecule according to the invention, for example by the nucleic acid molecule as shown in table I, application no. 16, columns 5 and 7 or its herein described functional homologues and has the herein mentioned activity.

/ for the disclosure of the paragraphs [0065.0.0.15] and [0066.0.0.15] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 16, columns 5 and 7 or its homologs activity having herein-mentioned citramalic acid, glyceric acid, fumaric acid, malic acid, pyruvic acid, succinic acid and/or threonolactone, their salts, amides, thioesters and/or esters increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 16, columns 5 and 7, e.g. a nucleic acid sequence encoding a polypeptide having the activity of a protein as indicated in table II, application no. 16, columns 5 and 7 or its homologs activity or of a mRNA encoding the polypeptide of the present invention having herein-mentioned citramalic acid, glyceric acid, fumaric acid, malic acid, pyruvic acid, succinic acid and/or threonolactone, their salts, amides, thioesters and/or esters increasing activity; and/or c) increasing the specific activity of a protein conferring the increased expression of a protein encoded by the nucleic acid molecule of the invention or of the polypeptide of the present invention having herein-mentioned citramalic acid, glyceric acid, fumaric acid, malic acid, pyruvic acid, succinic acid and/or threonolactone, their salts, amides, thioesters and/or esters increasing activity, e.g. of a polypeptide having the activity of a protein as indicated in table II, application no. 16, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned citramalic acid, glyceric acid, fumaric acid, malic acid, pyruvic acid, succinic acid and/or threonolactone, their salts, amides, thioesters and/or esters increasing activity, e.g. of a polypeptide having the activity of a protein as indicated in table II, application no. 16, columns 5 and 7 or its homologs activity; and/or e) stimulating activity of a protein conferring the increased expression of a protein encoded by the nucleic acid molecule of the present invention or a polypeptide of the present invention having herein-mentioned citramalic acid, glyceric acid, fumaric acid, malic acid, pyruvic acid, succinic acid and/or threonolactone, their salts, amides, thioesters and/or esters increasing activity, e.g. of a polypeptide having the activity of a protein as indicated in table II, application no. 16, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned citramalic acid, glyceric acid, fumaric acid, malic acid, pyruvic acid, succinic acid and/or threonolactone, their salts, amides, thioesters and/or esters increasing activity, e.g. of a polypeptide having the activity of a protein as indicated in table II, application no. 16, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned citramalic acid, glyceric acid, fumaric acid, malic acid, pyruvic acid, succinic acid and/or threonolactone, their salts, amides, thioesters and/or esters increasing activity, e.g. of a polypeptide having the activity of a protein as indicated in table II, application no. 16, columns 5 and 7 or its homologs activity; and/or h) increasing the expression of the endogenous gene encoding the polypeptide of the invention, e.g. a polypeptide having the activity of a protein as indicated in table II, application no. 16, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned citramalic acid, glyceric acid, fumaric acid, malic acid, pyruvic acid, succinic acid and/or threonolactone, their salts, amides, thioesters and/or esters increasing activity, e.g. of polypeptide having the activity of a protein as indicated in table II, application no. 16, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned citramalic acid, glyceric acid, fumaric acid, malic acid, pyruvic acid, succinic acid and/or threonolactone, their salts, amides, thioesters and/or esters increasing activity, e.g. of a polypeptide having the activity of a protein as indicated in table II, application no. 16, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned citramalic acid, glyceric acid, fumaric acid, malic acid, pyruvic acid, succinic acid and/or threonolactone, their salts, amides, thioesters and/or esters increasing activity, e.g. of a polypeptide having the activity of a protein as indicated in table II, application no. 16, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 16, column 3 or its homologs. Preferably the increase of the fine chemical takes place in plastids.

for the disclosure of the paragraphs [0069.0.0.15] to [0079.0.0.15] see paragraphs [0069.0.0.0] to [0079.0.0.0] above.

The activation of an endogenous polypeptide having above-mentioned activity, e.g. having the activity of a protein as shown in table II, application no. 16, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 16, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 16, column 3. The expression of the chimeric transcription factor in a organism, in particular in a plant, leads to a specific expression of the protein as shown in table II, application no. 16, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.15] to [0084.0.0.15] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. citramalic acid, glyceric acid, fumaric acid, malic acid, pyruvic acid, succinic acid and/or threonolactone, their salts, amides, thioesters and/or esters and mixtures thereof.

for the disclosure of this paragraph see paragraph [0086.0.0.0] above.

By influencing the metabolism thus, it is possible to produce, in the process according to the invention, further advantageous compounds. Examples of such compounds are, in addition to citramalic acid, glyceric acid, fumaric acid, malic acid, pyruvic acid, succinic acid and/or threonolactone, their salts, amides, thioesters and/or esters compounds such as other organic acids, vitamins or fatty acids.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 16, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound organic acids such as citramalic acid, glyceric acid, fumaric acid, malic acid, pyruvic acid, succinic acid and/or threonolactone, their salts, amides, thioesters and/or esters.

for the disclosure of the paragraphs [0090.0.0.15] to [0097.0.0.15] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 16, columns 5 and 7 or a derivative thereof, or
b) a genetic regulatory element, for example a promoter, which is functionally linked to the nucleic acid sequence as shown table I, application no. 16, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 16, columns 5 and 7 joined to a nucleic acid sequence encoding a transit peptide, or a targeting nucleic acid sequence which directs the nucleic acid sequences disclosed in table I, application no. 16, columns 5 and 7 to the organelle preferentially the plastids. Altenatively the inventive nucleic acids sequences consist advantageously of the nucleic acid sequences as depicted in the sequence protocol and disclosed in table I, application no. 16, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose citramalic acid, glyceric acid, fumaric acid, malic acid, pyruvic acid, succinic acid and/or threonolactone, their salts, amides, thioesters and/or esters content is modified advantageously owing to the nucleic acid molecule of the present invention expressed. This is important for plant breeders since, for example, the nutritional value of plants for poultry is dependent on the abovementioned citramalic acid, glyceric acid, fumaric acid, malic acid, pyruvic acid, succinic acid and/or threonolactone, their salts, amides, thioesters and/or esters and the general amount of citramalic acid, glyceric acid, fumaric acid, malic acid, pyruvic acid, succinic acid and/or threonolactone, their salts, amides, thioesters and/or esters as energy source and/or protecting compounds citramalic acid, glyceric acid, fumaric acid, malic acid, pyruvic acid, succinic acid and/or threonolactone, their salts, amides, thioesters and/or esters in feed. After the activity of the protein as shown in table II, application no. 16, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.15] to [0110.0.0.15] see paragraphs [0102.0.0.0] to [0110.0.0.0] above.

In a preferred embodiment, the fine chemical (citramalic acid, glyceric acid, fumaric acid, malic acid, pyruvic acid, succinic acid and/or threonolactone, their salts, amides, thioesters and/or esters) is produced in accordance with the invention and, if desired, is isolated. The production of further organic acid such as citric acid, α-ketoglutaric acid, itaconic acid and mixtures thereof or mixtures of other organic acids by the process according to the invention is advantageous. It may be advantageous to increase the pool of free organic acids such as citramalic acid, glyceric acid, fumaric acid, malic acid, pyruvic acid, succinic acid and/or threonolactone, their salts, amides, thioesters and/or esters in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example another gene of the citramalic acid, glyceric acid, fumaric acid, malic acid, pyruvic acid, succinic acid and/or threonolactone, their salts, amides, thioesters and/or esters biosynthesis, or a compound, which functions as a sink for the desired organic acids such as citramalic acid, glyceric acid, fumaric acid, malic acid, pyruvic acid, succinic acid and/or threonolactone, their salts, amides, thioesters and/or esters in the organism is useful to increase the production of the respective fine chemical.

In a preferred embodiment, the respective fine chemical is produced in accordance with the invention and, if desired, is isolated. The production of further organic acids other then citramalic acid, glyceric acid, fumaric acid, malic acid, pyruvic acid, succinic acid and/or threonolactone, their salts, amides, thioesters and/or esters or compounds for which the respective fine chemical is a biosynthesis precursor compounds, e.g. amino acids, or mixtures thereof or mixtures of other organic acids, in particular of citramalic acid, glyceric acid, fumaric acid, malic acid, pyruvic acid, succinic acid and/or threonolactone, their salts, amides, thioesters and/or esters, by the process according to the invention is advantageous.

In the case of the fermentation of microorganisms, the above-mentioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fine chemical such as citramalic acid, glyceric acid, fumaric acid, malic acid, pyruvic acid, succinic acid and/or threonolactone, their salts, amides, thioesters and/or esters synthesized in the process according to the invention can advantageously be marketed directly without there being any need for the fine chemical synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

However, the respective fine chemical produced in the process according to the invention can also be isolated from the organisms, advantageously plants, (in the form of their organic extracts, e.g. amide, ester, alcohol, or other organic solvents or water containing extract and/or free organic acids citramalic acid, glyceric acid, fumaric acid, malic acid, pyruvic acid, succinic acid and/or threonolactone, their salts, amides, thioesters and/or esters or other extracts. The respective fine chemical produced by this process can be obtained by harvesting the organisms, either from the medium in which they grow, or from the field. This can be done via pressing or extraction of the plant parts. To increase the efficiency of extraction it is beneficial to clean, to temper and if necessary to hull and to flake the plant material. To allow for greater ease of disruption of the plant parts, specifically the seeds, they can previously be comminuted, steamed or roasted. Seeds, which have been pretreated in this manner can subsequently be pressed or extracted with solvents such as organic solvents like warm hexane or water or mixtures of organic solvents and water. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid.

Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose. However, it can be advantageous to avoid this treatment as it can result in cells devoid of most carotenoids.

The identity and purity of the compound(s) isolated can be determined by prior-art techniques. They encompass high-performance liquid chromatographic (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 1127-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Citramalic acid, glyceric acid, fumaric acid, malic acid, pyruvic acid, succinic acid and/or threonolactone, their salts, amides, thioesters and/or esters can for example be detected advantageously via HPLC, LC or GC separation methods. The unambiguous detection for the presence of organic acids, in particular citramalic acid, glyceric acid, fumaric acid, malic acid, pyruvic acid, succinic acid and/or threonolactone, their salts, amides, thioesters and/or esters containing products can be obtained by analyzing recombinant organisms using analytical standard methods: LC, LC-MS, MS or TLC). The material to be analyzed can be disrupted by sonication, grinding in a glass mill, liquid nitrogen and grinding, cooking, or via other applicable methods In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 16, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 16, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table III, application no. 16, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 16, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 16, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 16, columns 5 and 7 by one or more nucleotides. In one embodiment, the nucleic acid molecule used in the process of the invention does not consist of the sequence indicated in table IA, application no. 16, columns 5 and 7. In one embodiment, the nucleic acid molecule used in the process of the invention is less than 100%, 99.999%, 99.99%, 99.9% or 99% identical to a sequence indicated in table IA, application no. 16, columns 5 and 7. In another embodiment, the nucleic acid molecule does not encode a polypeptide of a sequence indicated in table IIA, application no. 16, columns 5 and 7.

In one embodiment, the nucleic acid molecule used in the process of the invention distinguishes over the sequence indicated in table IB, application no. 16, columns 5 and 7, by one or more nucleotides. In one embodiment, the nucleic acid molecule used in the process of the invention does not consist of the sequence indicated in table IB, application no. 16, columns 5 and 7. In one embodiment, the nucleic acid molecule used in the process of the invention is less than 100%, 99.999%, 99.99%, 99.9% or 99% identical to a sequence indicated in table IB, application no. 16, columns 5 and 7. In another embodiment, the nucleic acid molecule does not encode a polypeptide of a sequence indicated in table IIB, application no. 16, columns 5 and 7.

In one embodiment, the nucleic acid molecule used in the process distinguishes over the sequence shown in table I, application no. 16, columns 5 and 7 by one or more nucleotides or does not consist of the sequence shown in table I, application no. 16, columns 5 and 7. In one embodiment, the nucleic acid molecule of the present invention is less than 100%, 99.999%, 99.99%, 99.9% or 99% identical to the sequence shown in table I, application no. 16, columns 5 and 7. In another embodiment, the nucleic acid molecule does not encode a polypeptide of the sequence shown in table II, application no. 16, columns 5 and 7.

for the disclosure of the paragraphs [0118.0.0.15] to [0120.0.0.15] see paragraphs [0118.0.0.0] to [0120.0.0.0] above.

Nucleic acid molecules with the sequence shown in table I, application no. 16, columns 5 and 7, nucleic acid molecules which are derived from the amino acid sequences shown in table II, application no. 16, columns 5 and 7 or from polypeptides comprising the consensus sequence shown in table IV, application no. 16, column 7, or their derivatives or homologues encoding polypeptides with the enzymatic or biological activity of a protein as shown in table II, application no. 16, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 16, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 16, column 3 and conferring the fine chemical increase by expression either in the cytsol or in an organelle such as a plastid or mitochondria or both, preferably in plastids.

for the disclosure of the paragraphs [0126.0.0.15] to [0133.0.0.15] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 16, columns 5 and 7 or the functional homologues thereof as described herein, preferably conferring above-mentioned activity, i.e. conferring the fine chemical increase after increasing its activity, e.g. after increasing the activity of a protein as shown in table II, application no. 16, column 3 by for example expression either in the cytsol or in an organelle such as a plastid or mitochondria or both, preferably in plastids.

for the disclosure of the paragraphs [0135.0.0.15] to [0140.0.0.15] see paragraphs [0135.0.0.0] to [0140.0.0.0] above.

Synthetic oligonucleotide primers for the amplification, e.g. as shown in table IIII, application no. 16, column 7, by means of polymerase chain reaction can be generated on the basis of a sequence shown herein, for example the sequence shown in table I, application no. 16, columns 5 and 7 or the sequences derived from table II, application no. 16, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 16, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 16, column 3 or further functional homologs of the polypeptide of the invention from other organisms.

for the disclosure of the paragraphs [0144.0.0.15] to [0151.0.0.15] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 16, columns 5 and 7, preferably of table IB, application no. 16, columns 5 and 7 under relaxed hybridization conditions and which code on expression for peptides having the citramalic acid, glyceric acid, fumaric acid, malic acid, pyruvic acid, succinic acid and/or threonolactone, their salts, amides, thioesters and/or esters increasing activity.

for the disclosure of the paragraphs [0153.0.0.15] to [0159.0.0.15] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 16, columns 5 and 7, preferably shown in table IB, application no. 16, columns 5 and 7 is one which is sufficiently complementary to one of the nucleotide sequences shown in table I, application no. 16, columns 5 and 7, preferably shown in table IB, application no. 16, columns 5 and 7 such that it can hybridize to one of the nucleotide sequences shown in table I, application no. 16, columns 5 and 7, preferably shown in table IB, application no. 16, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 16, columns 5 and 7, preferably shown in table IB, application no. 16, columns 5 and 7, or a portion thereof and preferably has above mentioned activity, in particular having a fine chemical increasing activity after increasing the activity or an activity of a gene product as shown in table II, application no. 16, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 16, columns 5 and 7, preferably shown in table IB, application no. 16, columns 5 and 7, or a portion thereof and encodes a protein having above-mentioned activity, e.g. conferring of a citramalic acid, glyceric acid, fumaric acid, malic acid, pyruvic acid, succinic acid and/or threonolactone, their salts, amides, thioesters and/or esters increase by for example expression either in the cytsol or in an organelle such as a plastid or mitochondria or both, preferably in plastids, and optionally, the activity of a protein as shown in table II, application no. 16, column 3.

Moreover, the nucleic acid molecule of the invention can comprise only a portion of the coding region of one of the sequences shown in table I, application no. 16, columns 5 and 7, preferably shown in table IB, application no. 16, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 16, columns 5 and 7, an anti-sense sequence of one of the sequences, e.g., set forth in table I, application no. 16, columns 5 and 7, preferably shown in table IB, application no. 16, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 16, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 16, columns 5 and 7 such that the protein or portion thereof maintains the ability to participate in the fine chemical production, in particular a citramalic acid, glyceric acid, fumaric acid, malic acid, pyruvic acid, succinic acid and/or threonolactone, their salts, amides, thioesters and/or esters increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 16, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 16, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.15] and [0169.0.0.15] see paragraphs [0168.0.0.0] and [0169.0.0.0] above.

The invention further relates to nucleic acid molecules that differ from one of the nucleotide sequences shown in table I, application no. 16, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 16, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 16, columns 5 and 7 or the functional homologues. In a still further embodiment, the nucleic acid molecule of the invention encodes a full length protein which is substantially homologous to an amino acid sequence shown in table II, application no. 16, columns 5 and 7 or the functional homologues. However, in a preferred embodiment, the nucleic acid molecule of the present invention does not consist of the sequence shown in table I, application no. 16, columns 5 and 7, preferably as indicated in table IA, application no. 16, columns 5 and 7. Preferably the nucleic acid molecule of the invention is a functional homologue or identical to a nucleic acid molecule indicated in table IB, application no. 16, columns 5 and 7.

for the disclosure of the paragraphs [0171.0.0.15] to [0173.0.0.15] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 16, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 16, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 16, columns 5 and 7.

for the disclosure of the paragraphs [0179.0.0.15] and [0180.0.0.15] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 16, columns 5 and 7, preferably shown in table IIA, application no. 16, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 16, columns 5 and 7, preferably shown in table IIA, application no. 16, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 16, columns 5 and 7, preferably shown in table IIA, application no. 16, columns 5 and 7, more preferably at least about 70% identical to one of the sequences shown in table II, application no. 16, columns 5 and 7, preferably shown in table IIA, application no. 16, columns 5 and 7, even more preferably at least about 80%, 90%, 95% homologous to the sequence shown in table II, application no. 16, columns 5 and 7, preferably shown in table IIA, application no. 16, columns 5 and 7, and most preferably at least about 96%, 97%, 98%, or 99% identical to the sequence shown in table II, application no. 16, columns 5 and 7, preferably shown in table IIA, application no. 16, columns 5 and 7.

for the disclosure of the paragraphs [0182.0.0.15] to [0188.0.0.15] see paragraphs [0182.0.0.0] to [0188.0.0.0] above.

Functional equivalents derived from one of the polypeptides as shown in table II, application no. 16, columns 5 and 7, preferably shown in table IIB, application no. 16, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 16, columns 5 and 7, preferably shown in table IIB, application no. 16, columns 5 and 7 resp., according to the invention and are distinguished by essentially the same properties as the polypeptide as shown in table II, application no. 16, columns 5 and 7, preferably shown in table IIB, application no. 16, columns 5 and 7.

Functional equivalents derived from the nucleic acid sequence as shown in table I, application no. 16, columns 5 and 7, preferably shown in table IB, application no. 16, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 16, columns 5 and 7, preferably shown in table IIB, application no. 16, columns 5 and 7 resp., according to the invention and encode polypeptides having essentially the same properties as the polypeptide as shown in table II, application no. 16, columns 5 and 7, preferably shown in table IIB, application no. 16, columns 5 and 7.

for the disclosure of this paragraph see paragraph [0191.0.0.0] above.

A nucleic acid molecule encoding an homologous to a protein sequence of table II, application no. 16, columns 5 and 7, preferably shown in table IIB, application no. 16, columns 5 and 7 resp., can be created by introducing one or more nucleotide substitutions, additions or deletions into a nucleotide sequence of the nucleic acid molecule of the present invention, in particular of table I, application no. 16, columns 5 and 7, preferably shown in table IB, application no. 16, columns 5 and 7 resp., such that one or more amino acid substitutions, additions or deletions are introduced into the encoded protein. Mutations can be introduced into the encoding sequences of table I, application no. 16, columns 5 and 7, preferably shown in table IB, application no. 16, columns 5 and 7 resp., by standard techniques, such as site-directed mutagenesis and PCR-mediated mutagenesis.

for the disclosure of the paragraphs [0193.0.0.15] to [0196.0.0.15] see paragraphs [0193.0.0.0] to [0196.0.0.0] above.

Homologues of the nucleic acid sequences used, with the sequence shown in table I, application no. 16, columns 5 and 7, preferably shown in table IB, application no. 16, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 16, columns 5 and 7, preferably shown in table IB, application no. 16, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 16, columns 5 and 7, preferably shown in table IB, application no. 16, columns 5 and 7. It is preferred that the nucleic acid molecule comprises as little as possible other nucleotides not shown in any one of table I, application no. 16, columns 5 and 7, preferably shown in table IB, application no. 16, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 16, columns 5 and 7, preferably shown in table IB, application no. 16, columns 5 and 7.

Also preferred is that the nucleic acid molecule used in the process of the invention encodes a polypeptide comprising the sequence shown in table II, application no. 16, columns 5 and 7, preferably shown in table IIB, application no. 16, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 16, columns 5 and 7, preferably shown in table IIB, application no. 16, columns 5 and 7.

In one embodiment, the nucleic acid molecule of the invention or used in the process encodes a polypeptide comprising the sequence shown in table II, application no. 16, columns 5 and 7, preferably shown in table IIB, application no. 16, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 16, columns 5 and 7, preferably shown in table IB, application no. 16, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 16, columns 5 and 7 expressed under identical conditions.

Homologues of table I, application no. 16, columns 5 and 7 or of the derived sequences of table II, application no. 16, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.15] to [0215.0.0.15] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 16, columns 5 and 7, preferably in table IIB, application no. 16, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 16, columns 5 and 7, preferably in table IB, application no. 16, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 16, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 16, column 7 and conferring an increase in the amount of the fine chemical in an organism or a part thereof;

k) nucleic acid molecule encoding the amino acid sequence of a polypeptide encoding a domaine of the polypeptide shown in table II, application no. 16, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 16, columns 5 and 7 or a nucleic acid molecule encoding, preferably at least the mature form of, the polypeptide shown in table II, application no. 16, columns 5 and 7, and conferring an increase in the amount of the fine chemical in an organism or a part thereof; or which encompasses a sequence which is complementary thereto; whereby, preferably, the nucleic acid molecule according to (a) to (l) distinguishes over the sequence depicted in table IA and/or IB, application no. 16, columns 5 and 7 by one or more nucleotides. In one embodiment, the nucleic acid molecule of the invention does not consist of the sequence shown in table IA and/or IB, application no. 16, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 16, columns 5 and 7. In a further embodiment the nucleic acid molecule does not encode the polypeptide sequence shown in table IIA and/or IIB, application no. 16, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 16, columns 5 and 7 does not encode a protein of the sequence shown in table IIA and/or IIB, application no. 16, columns 5 and 7. Accordingly, in one embodiment, the protein encoded by a sequence of a nucleic acid according to (a) to (l) does not consist of the sequence shown in table IA and/or IB, application no. 16, columns 5 and 7. In a further embodiment, the protein of the present invention is at least 30% identical to protein sequence depicted in table IIA and/or IIB, application no. 16, columns 5 and 7 and less than 100%, preferably less than 99.999%, 99.99% or 99.9%, more preferably less than 99%, 985, 97%, 96% or 95% identical to the sequence shown in table IIA and/or IIB, application no. 16, columns 5 and 7.

for the disclosure of the paragraphs [0217.0.0.15] to [0226.0.0.15] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in E. coli and in Agrobacterium. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 16, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.15] to [0239.0.0.15] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 16, columns 5 and 7 or its derivatives, it is advantageous additionally to express and/or mutate further genes in the organisms. Especially advantageously, additionally at least one further gene of the citramalic acid, glyceric acid, fumaric acid, malic acid, pyruvic acid, succinic acid and/or threonolactone, their salts, amides, thioesters and/or esters biosynthetic pathway is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 16, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the organic acid metabolism, in particular in synthesis of citramalic acid, glyceric acid, fumaric acid, malic acid, pyruvic acid, succinic acid and/or threonolactone, their salts, amides, thioesters and/or esters. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the above-mentioned biosynthesis genes are the sequences encoding further genes of the sugar metabolism, the citric cycle etc.

In a further advantageous embodiment of the process of the invention, the organisms used in the process are those in which simultaneously a citramalic acid, glyceric acid, fumaric acid, malic acid, pyruvic acid, succinic acid and/or threonolactone, their salts, amides, thioesters and/or esters degrading protein is attenuated, in particular by reducing the rate of expression of the corresponding gene, or by inactivating the gene for example the mutagenesis and/or selection. In another advantageous embodiment the synthesis of competitive pathways which rely on the same precoursers are down regulated or interrupted.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemical and other organic acids produced by this process can be obtained by harvesting the organisms, either from the crop in which they grow, or from the field. This can be done via for example pressing or extraction of the plant parts.

Preferably, the compound is a composition comprising the essentially pure citramalic acid, glyceric acid, fumaric acid, malic acid, pyruvic acid, succinic acid and/or threonolactone, their salts, amides, thioesters, esters or mixtures thereof or a recovered or isolated citramalic acid, glyceric acid, fumaric acid, malic acid, pyruvic acid, succinic acid and/or threonolactone, their salts, amides, thioesters and/or esters.

for the disclosure of the paragraphs [0243.0.0.15] to [0264.0.0.15] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide or transit-peptide-encoding sequences which are known per se. For example, plastid transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 16, columns 5 and 7 and described herein to achieve an expression in one of said compartments or extracellular.

for the disclosure of the paragraphs [0266.0.0.15] to [0287.0.0.15] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 16, columns 5 and 7 or their homologs is functionally linked to a plastidial targeting sequence. A further preferred embodiment of the invention relates to a vector in which a nucleic acid sequence encoding one of the polypeptides shown in table II, application no. 16, columns 5 and 7 or their homologs is functionally linked to a regulatory sequences which permit the expression in plastids.

for the disclosure of the paragraphs [0289.0.0.15] to [0296.0.0.15] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0931, anti-b1046, anti-b1556, anti-b1732, anti-b2066, anti-b2312, anti-b3770, anti-b4122, anti-b4139, anti-YAL038W, anti-YDL078C, anti-YGL065C, anti-YGL126W, anti-YJL139C, anti-YKR043C, anti-YOL126C and/or anti-YOR350C protein antibody or an antibody against polypeptides as shown in table II, application no. 16, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 16, columns 5 and 7 or as coded by the nucleic acid molecule shown in table I, application no. 16, columns 5 and 7 or functional homologues thereof.

In one advantageous embodiment, in the method of the present invention the activity of a polypeptide is increased comprising or consisting of the consensus sequence shown in table IV, application no. 16, columns 7 and in one another embodiment, the present invention relates to a polypeptide comprising or consisting of the consensus sequence shown in table IV, application no. 16, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.15] to [0304.0.0.15] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 16, columns 5 and 7 by one or more amino acids. In one embodiment, polypeptide distinguishes form the sequence shown in table IIA and/or IIB, application no. 16, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 16, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 16, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 16, columns 5 and 7 by one or more amino acids. In another embodiment, said polypeptide of the invention does not consist of the sequence shown in table IIA and/or IIB, application no. 16, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 16, columns 5 and 7.

In one embodiment, the present invention relates to a polypeptide having the activity of the protein as shown in table IIA and/or IIB, application no. 16, column 3, which distinguishes over the sequence depicted in table IIA and/or IIB, application no. 16, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.15] to [0311.0.0.15] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 16, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 16, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 16, columns 5 and 7 or which is homologous thereto, as defined above.

Accordingly the polypeptide of the present invention can vary from the sequences shown in table IIA and/or IIB, application no. 16, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 16, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 16, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 16, column 3. Differences shall mean at least one amino acid different from the sequences as shown in table II, application no. 16, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 16, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 16, column 3. The nucleic acid molecules and polypeptide molecules of the invention are expressed such that the yield, production, and/or efficiency of production of a desired compound is improved.

for the disclosure of the paragraphs [0320.0.0.15] to [0322.0.0.15] see paragraphs [0320.0.0.0] to [0322.0.0.0] above.

In one embodiment, a protein (=polypeptide) as shown in table II, application no. 16, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 16, column 3, e.g., a protein which does not confer the activity described herein and which is derived from the same or a different organism.

for the disclosure of the paragraphs [0324.0.0.15] to [0329.0.0.15] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 16, columns 5 and 7.

for the disclosure of the paragraphs [0331.0.0.15] to [0346.0.0.15] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 16, column 3. Due to the above mentioned activity the fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 16, column 3 or a protein as shown in table II, application no. 16, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 16, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.15] to [0358.0.0.15] see paragraphs [0350.0.0.0] to [0358.0.0.0] above.

Transgenic plants comprising citramalic acid, glyceric acid, fumaric acid, malic acid, pyruvic acid, succinic acid and/or threonolactone, their salts, amides, thioesters, esters or mixtures thereof synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The citramalic acid, glyceric acid, fumaric acid, malic acid, pyruvic acid, succinic acid and/or threonolactone, their salts, amides, thioesters, esters or mixtures thereof produced in the process according to the invention may, however, also be isolated from the plant in the form of their free acids such as citramalic acid, glyceric acid, fumaric acid, malic acid, pyruvic acid or succinic acid, in form of the threonolactone, their salts, their amides, their thioesters, their esters or mixtures thereof produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, cosmetics, pharmaceuticals or fine chemicals.

for the disclosure of the paragraphs [0360.0.0.15] to [0362.0.0.15] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the organic acids such as citramalic acid, glyceric acid, fumaric acid, malic acid, pyruvic acid or succinic acid of the threonolactone, their salts, amides, thioesters, esters or mixtures thereof produced in the process can be isolated. The resulting fine chemical can, if appropriate, subsequently be further purified, if desired mixed with other active ingredients such as other xanthophylls, fatty acids, vitamins, amino acids, carbohydrates, antibiotics and the like, and, if appropriate, formulated.

In one embodiment, citramalic acid, glyceric acid, fumaric acid, malic acid, pyruvic acid, succinic acid and/or threonolactone, their salts, amides, thioesters, esters or mixtures thereof is the fine chemical.

The citramalic acid, glyceric acid, fumaric acid, malic acid, pyruvic acid, succinic acid and/or threonolactone, their salts, amides, thioesters, esters or mixtures thereof, in particular the respective fine chemicals obtained in the process are suitable as starting material for the synthesis of further products of value. For example, they can be used in combination with each other or alone for the production of pharmaceuticals, health products, foodstuffs, animal feeds, nutrients or cosmetics. Accordingly, the present invention relates a method for the production of pharmaceuticals, health products, food stuff, animal feeds, nutrients or cosmetics comprising the steps of the process according to the invention, including the isolation of the citramalic acid, glyceric acid, fumaric acid, malic acid, pyruvic acid, succinic acid and/or threonolactone, their salts, amides, thioesters, esters or mixtures thereof containing, in particular citramalic acid, glyceric acid, fumaric acid, malic acid, pyruvic acid, succinic acid and/or threonolactone or mixtures thereof containing composition produced or the respective fine chemical produced if desired and formulating the product with a pharmaceutical acceptable carrier or formulating the product in a form acceptable for an application in agriculture. A further embodiment according to the invention is the use of the citramalic acid, glyceric acid, fumaric acid, malic acid, pyruvic acid, succinic acid and/or threonolactone, their salts, amides, thioesters, esters or mixtures thereof produced in the process or of the transgenic organisms in animal feeds, foodstuffs, medicines, food supplements, cosmetics or pharmaceuticals.

for the disclosure of the paragraphs [0366.0.0.15] to [0369.0.0.15] see paragraphs [0366.0.0.0] to [0369.0.0.0] above.

The fermentation broths obtained in this way, containing in particular citramalic acid, glyceric acid, fumaric acid, malic acid, pyruvic acid, succinic acid and/or threonolactone, their salts, amides, thioesters, esters or mixtures thereof or in mixtures with other organic acids, amino acids, polypeptides or polysaccharides, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the citramalic acid, glyceric acid, fumaric acid, malic acid, pyruvic acid, succinic acid and/or threonolactone, their salts, amides, thioesters, esters or mixtures thereof, in particular the citramalic acid, glyceric acid, fumaric acid, malic acid, pyruvic acid, succinic acid and/or threonolactone produced according to the invention further. For this purpose, the product-containing composition, e.g. a total or partial extraction fraction using organic solvents or water, is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.15] to [0376.0.0.15], [0376.1.0.15] and [0377.0.0.15] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 16, columns 5 and 7, preferably in table IB, application no. 16, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.15] to [0383.0.0.15] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 16, column 3, e.g. comparing near identical organisms with low and high activity of the proteins as shown in table II, application no. 16, column 3.

for the disclosure of the paragraphs [0385.0.0.15] to [0404.0.0.15] see paragraphs [0385.0.0.0] to [0404.0.0.0] above.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other organic acids, in particular the organic acids such as citric acid, oxaloacetic acid, cis-aconitic acid, isocitric acid, oxalosuccinic acid or ketoglutaric acid.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the fine chemical in an organism or part thereof, e.g. in a cell.

for the disclosure of the paragraphs [0406.0.0.15] to [0435.0.0.15] see paragraphs [0406.0.0.0] to [0435.0.0.0] above.

Production of citramalic acid, glyceric acid, fumaric acid, malic acid, pyruvic acid, succinic acid and/or threonolactone, their salts, amides, thioesters, esters or mixtures thereof in *Chlamydomonas reinhardtii*

The citramalic acid, glyceric acid, fumaric acid, malic acid, pyruvic acid, succinic acid and/or threonolactone, their salts, amides, thioesters, esters or mixtures thereof production can be analysed as mentioned herein.

The proteins and nucleic acids can be analysed as mentioned below.

In addition a production in other organisms such as plants or microorganisms such as yeast, *Mortierella* or *Escherichia coli* is possible.

for the disclosure of the paragraphs [0437.0.0.15] and [0438.0.0.15] see paragraphs [0437.0.0.0] and [0438.0.0.0] above.

Example 9

Analysis of the Effect of the Nucleic Acid Molecule on the Production of Citramalic Acid, Glyceric Acid, Fumaric Acid, Malic Acid, Pyruvic Acid, Succinic Acid and/or Threonolactone, their Salts, Amides, Thioesters, Esters or Mixtures thereof The effect of the genetic modification of plants or algae on the production of a desired compound (such as citramalic acid, glyceric acid, fumaric acid, malic acid, pyruvic acid, succinic acid and/or threonolactone, their salts, amides, thioesters, esters or mixtures thereof) can be determined by growing the modified plant under suitable conditions (such as those described above) and analyzing the medium and/or the cellular components for the elevated production of desired product (i.e. of citramalic acid, glyceric acid, fumaric acid, malic acid, pyruvic acid, succinic acid and/or threonolactone). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter II, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of and Determination of the Citramalic Acid, Glyceric Acid, Fumaric Acid, Malic Acid, Pyruvic Acid, Succinic Acid and/or Threonolactone, their Salts, Amides, Thioesters, Esters or Mixtures thereofontent:

Abbreviations: GC-MS, gas liquid chromatography/mass spectrometry; TLC, thin-layer chromatography.

The unambiguous detection for the presence of organic acids can be obtained by analyzing recombinant organisms using analytical standard methods: LC, LC-MSMS or TLC, as described The total citramalic acid, glyceric acid, fumaric acid, malic acid, pyruvic acid, succinic acid and/or threonolactone, their salts, amides, thioesters, esters or mixtures thereof produced in the organism for example in algae used in the inventive process can be analysed for example according to the following procedure:

The material such as algae or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, seperation of non-polar epiphase from more polar hypophasic derivatives and chromatography. E.g.:

For analysis, solvent delivery and aliquot removal can be accomplished with a robotic system comprising a single injector valve Gilson 232XL and a 4022S1V diluter [Gilson, Inc. USA, 3000 W. Beltline Highway, Middleton, Wis.]. For saponification, 3 ml of 50% potassium hydroxide hydro-ethanolic solution (4 water:1 ethanol) can be added to each vial, followed by the addition of 3 ml of octanol. The saponification treatment can be conducted at room temperature with vials maintained on an IKA HS 501 horizontal shaker [Labworld-online, Inc., Wilmington, N.C.] for fifteen hours at 250 movements/minute, followed by a stationary phase of approximately one hour.

Following saponification, the supernatant can be diluted with 0.10 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol: 4 water: 15 tetrahydrofuran (THF) stabilized with 0.2% BHT (2,6-di-tert-butyl4-methylphenol). Injections were 20 µl. Separation can be isocratic at 30° C. with a flow rate of 1.7 ml/minute. The peak responses can be measured by absorbance at 447 nm.

If required and desired, further chromatography steps with a suitable resin may follow. Advantageously, the citramalic acid, glyceric acid, fumaric acid, malic acid, pyruvic acid, succinic acid and/or threonolactone, their salts, amides, thioesters, esters or mixtures thereof can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

for the disclosure of the paragraphs [0446.0.0.15] to [0496.0.0.15] see paragraphs [0446.0.0.0] to [0496.0.0.0] above.

As an alternative, the organic acids such as citramalic acid, glyceric acid, fumaric acid, malic acid, pyruvic acid, succinic acid and/or threonolactone can be detected as described in Farré, E. et al., Plant Physiol, 2001, Vol. 127, pp. 685-700.

The results of the different plant analyses can be seen from the table, which follows:

TABLE VI

| ORF | Metabolite | Method | Min | Max |
| --- | --- | --- | --- | --- |
| b0931 | Fumarate | LC | 1.47 | 4.65 |
| b1046 | Glyceric acid | GC | 1.31 | 1.65 |
| b1556 | Fumarate | GC | 2.36 | 4.72 |
| b1556 | Succinate | LC | 1.47 | 3.04 |
| b1556 | Threonolacton | GC | 1.38 | 2.03 |
| b1732 | Succinate | LC | 1.28 | 1.37 |
| b2066 | Malate | GC | 1.70 | 3.92 |
| b2312 | Succinate | GC | 1.24 | 1.33 |
| b3770 | Citramalate | GC | 1.49 | 3.23 |
| b4122 | Fumarate | GC | 2.53 | 5.44 |
| b4139 | Fumarate | GC | 14.94 | 25.37 |
| YAL038W | Succinate | LC | 1.40 | 4.67 |
| YAL038W | Pyruvate | GC | 1.37 | 2.64 |
| YAL038W | Citramalate | GC | 1.72 | 4.37 |
| YDL078C | Malate | GC | 1.83 | 4.71 |
| YGL065C | Succinate | LC | 1.08 | 1.21 |
| YGL126W | Succinate | LC | 1.30 | 1.45 |
| YJL139C | Fumarate | GC | 1.55 | 4.10 |
| YKR043C | Matate | GC | 1.54 | 3.16 |
| YKR043C | Fumarate | GC | 10.90 | 15.35 |
| YOL126C | Fumarate | GC | 2.00 | 2.18 |
| YOL126C | Malate | GC | 1.83 | 3.04 |
| YOR350C | Glyceric acid | GC | 1.41 | 1.51 | for the disclosure of the paragraphs [0499.0.0.15] and [0500.0.0.15] see paragraphs [0499.0.0.0] and [0500.0.0.0] above.

Example 15a

Engineering Ryegrass Plants by Over-Expressing b0931 from *Escherichia coli* or Homologs of b0931 from Other Organisms for the disclosure of the paragraphs [0502.0.0.15] to [0508.0.0.15] see paragraphs [0502.0.0.0] to [0508.0.0.0] above.

Example 15b

Engineering Soybean Plants by Over-Expressing b0931 from *Escherichia coli* or Homologs of b0931 from Other Organisms for the disclosure of the paragraphs [0510.0.0.15] to [0513.0.0.15] see paragraphs [0510.0.0.0] to [0513.0.0.0] above.

Example 15c

Engineering Corn Plants by Over-Expressing b0931 from *Escherichia coli* or Homologs of b0931 from Other Organisms for the disclosure of the paragraphs [0515.0.0.15] to [0540.0.0.15] see paragraphs [0515.0.0.0] to [0540.0.0.0] above.

Example 15d

Engineering Wheat Plants by Over-Expressing b0931 from *Escherichia coli* or Homologs of b0931 from Other Organisms for the disclosure of the paragraphs [0542.0.0.15] to [0544.0.0.15] see paragraphs [0542.0.0.0] to [0544.0.0.0] above.

Example 15e

Engineering Rapeseed/Canola Plants by Over-Expressing b0931 from *Escherichia coli* or Homologs of b0931 from Other Organisms for the disclosure of the paragraphs [0546.0.0.15] to [0549.0.0.15] see paragraphs [0544.0.0.0] to [0549.0.0.0] above.

Example 15f

Engineering Alfalfa Plants by Over-Expressing b0931 from *Escherichia coli* or Homologs of b0931 from Other Organisms for the disclosure of the paragraphs [0551.0.0.15] to [0554.0.0.15] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII

TABLE VII

| ORF_NAME | Metabolite | MIN | MAX |
| --- | --- | --- | --- |
| b2066 | Malate | 1.99 | 3.02 |
| b4139 | Fumarate | 1.59 | 5.08 |
| YAL038W | Succinate | 1.33 | 3.78 |
| YAL038W | Pyruvate | 1.73 | 2.31 |
| YKR043C | Fumarate | 1.77 | 2.32 |

Table VII shows the increase in fumaric acid in genetically modified corn plants expressing the *Saccharomyces cerevisiae* nucleic acid sequence YKR043C and the *E. coli* nucleic acid sequence b4139, the increase in malic acid in genetically modified corn plants expressing the *E. coli* nucleic acid sequence b2066, and the increase in pyruvic and succinic acid in genetically modified corn plants expressing the *Saccharomyces cerevisiae* nucleic acid sequence YAL038W.

In one embodiment, in case the activity of the *Saccaromyces cerevisiae* protein YKR043C or its homologs, e.g. a "phosphoglycerate mutase like protein", is increased in corn plants, preferably, an increase of the fine chemical fumaric acid (=fumarate) between 77% and 132% or more is conferred.

In one embodiment, in case the activity of the *Escherichia coli* protein b4139 or its homologs, e.g. a "aspartate ammonia-lyase (aspartase)", is increased in corn plants, preferably, an increase of the fine chemical fumaric acid (=fumarate) acid between 59% and 408% or more is conferred.

In another embodiment, in case the activity of the *Saccaromyces cerevisiae* protein YAL038W or its homologs, e.g. a "pyruvate kinase", is increased in corn plants, preferably, an increase of the fine chemical succinic acid (=succinate) between 33% and 278% or more is conferred.

In another embodiment, in case the activity of the *Saccaromyces cerevisiae* protein YAL038W or its homologs, e.g. a "pyruvate kinase", is increased in corn plants, preferably, an increase of the fine chemical pyruvic acid (=pyruvate) between 73% and 131% or more is conferred.

In another embodiment, in case the activity of the *Saccaromyces cerevisiae* protein YAL038W or its homologs, e.g. a "pyruvate kinase", is increased in corn plants, preferably, an increase of the fine chemical pyruvic acid (=pyruvate) between 73% and 131% or more and/or succinic acid (=succinate) between 33% and 278% or more is conferred.

In one embodiment, in case the activity of the *Escherichia coli* protein b2066 or its homologs, e.g. a "uridine/cytidine kinase", is increased in corn plants, preferably, an increase of the fine chemical malic acid (=malate) acid between 99% and 202% or more is conferred.

for the disclosure of this paragraph see [0554.2.0.0] above.
for the disclosure of this paragraph see [0555.0.0.0] above.
for the disclosure of this paragraph see [0001.0.0.0].

Gamma-aminobutyric acid is used to enhance growth of specified plants, prevent development of powdery mildew on grapes, and suppress certain other plant diseases. Humans and animals normally ingest and metabolize gamma-aminobutyric acid in variable amounts. Gamma-aminobutyric acid was registered (licensed for sale) as growth enhancing pesticidal active ingredient in 1998. Gamma-aminobutyric acid is an important signal which helps to regulate mineral availability in plants. Minerals support the biochemical pathways governing growth and reproduction as well as the pathways that direct plant's response to a variety of biotic and abiotic stresses. Mineral needs are especially high during times of stress and at certain stages of plant growth. Gamma-aminobutyric acid levels in plants naturally increase at these times.

Gamma-Aminobutyric acid (GABA), a nonprotein amino acid, is often accumulated in plants following environmental stimuli that can also cause ethylene production. Exogenous GABA causes up to a 14-fold increase in the ethylene production rate after about 12 h. GABA causes increases in ACC synthase mRNA accumulation, ACC levels, ACC oxidase mRNA levels and in vitro ACC oxidase activity. Possible roles of GABA as a signal transducer are suggested, see Plant Physiol. 115(1):129-35(1997)

Gamma-aminobutyric acid (GABA), a four-carbon nonprotein amino acid, is a significant component of the free amino acid pool in most prokaryotic and eukaryotic organisms. In plants, stress initiates a signal-transduction pathway, in which increased cytosolic $Ca^{2+}$ activates $Ca^{2+}$/calmodulin-dependent glutamate decarboxylase activity and GABA synthesis. Elevated $H^+$ and substrate levels can also stimulate glutamate decarboxylase activity. GABA accumulation probably is mediated primarily by glutamate decarboxylase. Experimental evidence supports the involvement of GABA synthesis in pH regulation, nitrogen storage, plant development and defense, as well as a compatible osmolyte and an alternative pathway for glutamate utilization, see Trends Plant Sci. 4(11):446-452(1999).

Gamma-aminobutyric acid enhances nutrient uptake by roots and leaves so that plant nutrient levels are higher than those achieved by using nutrients alone. When plants are stressed and nutrient uptake is limited, it is believed that gamma-aminobutyric acid facilitates nutrient utilization, thereby enhancing growth during stress. Rapid GABA accumulation in response to wounding may play a role in plant defense against insects (Ramputh and Brown, Plant Physiol. 111 (1996): 1349-1352). The development of gamma aminobutyrate (GABA) as a potential control agent in plant—invertebrate pest systems has been reviewed in Shelp et al., Canadien Journal of Botany (2003) 81, 11, 1045-1048. The authors describe that available evidence indicates that GABA accumulation in plants in response to biotic and abiotic stresses is mediated via the activation of glutamate decarboxylase. More applied research, based on the fact that GABA acts as an inhibitory neurotransmitter in invertebrate pests, indicates that ingested GABA disrupts nerve functioning and causes damage to oblique-banded leafroller larvae, and that walking or herbivory by tobacco budworm and oblique-banded leafroller larvae stimulate GABA accumulation in soybean and tobacco, respectively. In addition, elevated levels of endogenous GABA in genetically engineered tobacco deter feeding by tobacco budworm larvae and infestation by the northern root-knot nematode. Therefore the author concluded that genetically engineered crop species having high GABA-producing potential may be an alternative strategy to chemical pesticides for the management of invertebrate pests.

During angiosperm reproduction, pollen grains form a tube that navigates through female tissues to the micropyle, delivering sperm to the egg. In vitro, GABA stimulates pollen tube growth. The *Arabidopsis* POP2 gene encodes a transaminase that degrades GABA and contributes to the formation of a gradient leading up to the micropyle, see Cell. 114(1):47-59 (2003).

Due to these interesting physiological roles and agrobiotechnological potential of GABA there is a need to identify the genes of enzymes and other proteins involved in GABA metabolism, and to generate mutants or transgenic plant lines with which to modify the GABA content in plants.

Shikimic acid is found in various plants. It has two functional groups in the same molecule, hydroxyl groups and a carboxylic acid group which are optically active. They can yield various kinds of esters and salts. It belongs to the class of cyclitols, which means it is a hydroxylated cycloalkane containing at least three hydroxy groups, each attached to a different ring carbon atom.

A key intermediate in synthesis of virtually all aromatic compounds in the cells is shikimic acid. These include phenylalanine, tyrosine, tryptophan, p-aminobenzoic acid, and p-hydroxybenzoic acid.

Glyphosate (N-phosphonomethylglycine) is a non-selective, broad spectrum herbicide that is symplastically translocated to the meristems of growing plants. It causes shikimate accumulation through inhibition of the chloroplast localized EPSP synthase (5-enolpyruvylshikimate-3-phosphate synthase; EPSPs) [EC 2.5.1.19] (Amrhein et al, 1980, Plant Physiol. 66: 830-834).

The starting product of the biosynthesis of most phenolic compounds is shikimate. Phenols are acidic due to the dissociability of their —OH group. They are rather reactive compounds and as long as no steric inhibition due to additional side chains occurs, they form hydrogen bonds. Consequently, many flavonoids have intramolecular bonds. Another important feature is their ability to form chelate complexes with metals. Also, they are easily oxidized and, if so, form polymers (dark aggregates). The darkening of cut or dying plant parts is caused by this reaction. They have usually an inhibiting effect on plant growth. Among the phenylpropanol derivatives of lower molecular weight are a number of scents like the coumarins, cinnamic acid, sinapinic acid, the coniferyl alcohols and others. These substances and their derivatives are at the same time intermediates of the biosynthesis of lignin.

The shikimate pathway links metabolism of carbohydrates to biosynthesis of aromatic compounds. In a sequence of seven metabolic steps, phosphoenolpyruvate and erythrose 4-phosphate are converted to chorismate, the precursor of the aromatic amino acids and many aromatic secondary metabolites. All pathway intermediates can also be considered branch point compounds that may serve as substrates for other metabolic pathways. The shikimate pathway is found only in microorganisms and plants, never in animals. All enzymes of this pathway have been obtained in pure form from prokaryotic and eukaryotic sources and their respective DNAs have been characterized from several organisms. The cDNAs of higher plants encode proteins with amino terminal signal sequences for plastid import, suggesting that plastids are the exclusive locale for chorismate biosynthesis. In microorganisms, the shikimate pathway is regulated by feedback inhibition and by repression of the first enzyme. In higher plants, no physiological feedback inhibitor has been identified, suggesting that pathway regulation may occur exclusively at the genetic level. This difference between microorganisms and plants is reflected in the unusually large variation in the primary structures of the respective first enzymes. Several of the pathway enzymes occur in isoenzymic forms whose expression varies with changing environmental conditions and, within the plant, from organ to organ. The penultimate enzyme of the pathway is the sole target for the herbicide glyphosate. Glyphosate-tolerant transgenic plants are at the core of novel weed control systems for several crop plants (Annual Review of Plant Physiology and Plant Molecular Biology 50(1999): 473-503).

Natural products derived from shikimic acid range in complexity from the very simple, such as vanillin (used primarily as a flavoring agent), salicylic acid (the precursor of aspirin), lawsone (a naphthoquinone used in some sunscreens), and scopletin (a coumarin once used as a uterine sedative), to the more complex, such as the lignan lactone podophyllotoxin. Podophyllotoxin is basically a dimer incorporating two phenylpropanoid (a nine-carbon unit derived from shikimic acid) units. Podophyllotoxin was first isolated from Podophyllum peltatum, also known as mayapple or American mandrake, a plant which has a long history of use as a cathartic and purgative. Podophyllotoxin has been used to treat warts, and is a mitotic inhibitor which shows antineoplastic activity. Etoposide, in particular, is used to treat forms of lung cancer, testicular cancer, and acute lymphocytic leukemia.

Furthermore shikimic acid is an important starting substance for the production of pharmacological active substances. For example the synthesis of ® Roche's antiviral drug Tamiflu® (oseltamivir phosphate) starts from shikimic acid. Tamiflu® treats seasonal influenza and is also being expected as a first line of defense against a possible pandemic outbreak of bird flu. The 10-step commercial route uses the natural product (−)-shikimic acid as a starting material. This precursor is converted into a diethyl ketal intermediate, which is reductively opened to give a 1,2-epoxide. This epoxide is then converted into Tamiflu via a five-step reaction sequence involving three potentially toxic and explosive azide intermediates.

Putrescine is synthesized by healthy living cells by the action of ornithine decarboxylase, is one of the simplest polyamines and appears to be a growth factor necessary for cell division.

Experimental evidence indicate that polyamines may be involved in growth, differentiation or morphogenesis, stress and senescence in plants (Evans and Malmberg, 1989).

%
%
%
%

One way to increase the productive capacity of biosynthesis is to apply recombinant DNA technology. Thus, it would be desirable to produce gamma-aminobutyric acid and/or shikimate and/or putrescine in plants. That type of production permits control over quality, quantity and selection of the most suitable and efficient producer organisms. The latter is especially important for commercial production economics and therefore availability to consumers. In addition it is desirable to produce gamma-aminobutyric acid and/or shikimate and/or putrescine in plants in order to increase plant productivity and resistance against biotic and abiotic stress as discussed before.

Methods of recombinant DNA technology have been used for some years to improve the production of fine chemicals in microorganisms and plants by amplifying individual biosynthesis genes and investigating the effect on production of fine chemicals. It is for example reported, that the xanthophyll astaxanthin could be produced in the nectaries of transgenic tobacco plants. Those transgenic plants were prepared by *Argobacterium tumifaciens*-mediated transformation of tobacco plants using a vector that contained a ketolase-encoding gene from *H. pluvialis* denominated crtO along with the Pds gene from tomato as the promoter and to encode a leader sequence. Those results indicated that about 75 percent of the carotenoids found in the flower of the transformed plant contained a keto group.

Thus, it would be advantageous if an algae, plant or other microorganism were available which produce large amounts of gamma-aminobutyric acid and/or putrescine and/or shikimate. The invention discussed hereinafter relates in some embodiments to such transformed prokaryotic or eukaryotic microorganisms.

It would also be advantageous if plants were available whose roots, leaves, stem, fruits or flowers produced large amounts of aminobutyric acid and/or putrescine and/or shikimate. The invention discussed hereinafter relates in some embodiments to such transformed plants.

Therefore improving the quality of foodstuffs and animal feeds is an important task of the food-and-feed industry. This is necessary since, for example gamma-aminobutyric acid or shikimate, as mentioned above, which occur in plants and some microorganisms are limited with regard to the supply of mammals. Especially advantageous for the quality of foodstuffs and animal feeds is as balanced as possible a specific gamma-aminobutyric acid and/or shikimate and/or putrescine profile in the diet since an excess of gamma-aminobutyric acid and/or shikimate and/or putrescine above a specific concentration in the food has a positive effect. A further increase in quality is only possible via addition of further gamma-aminobutyric acid and/or shikimate and/or putrescine, which are limiting.

To ensure a high quality of foods and animal feeds, it is therefore necessary to add gamma-aminobutyric acid and/or shikimate and/or putrescine in a balanced manner to suit the organism.

Accordingly, there is still a great demand for new and more suitable genes which encode enzymes or other proteins which participate in the biosynthesis of gamma-aminobutyric acid and/or putrescine and/or shikimate and make it possible to produce them specifically on an industrial scale without unwanted byproducts forming. In the selection of genes for biosynthesis two characteristics above all are particularly important. On the one hand, there is as ever a need for improved processes for obtaining the highest possible contents of gamma-aminobutyric acid, putrescine and shikimate; on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is a gamma-aminobutyric acid and/or putrescine and/or shikimate. Accordingly, in the present invention, the term "the fine chemical" as used herein relates to a "gamma-aminobutyric acid and/or putrescine and/or shikimate". Further, the term "the fine chemicals" as used herein also relates to fine chemicals comprising gamma-aminobutyric acid and/or putrescine and/or shikimate.

In one embodiment, the term "the fine chemical" or "the respective fine chemical" means at least one chemical compound with gamma-aminobutyric acid and/or putrescine and/or shikimate. Throughout the specification the term "the fine chemical" or "the respective fine chemical" means a gamma-aminobutyric acid and/or putrescine and/or shikimate in free form or bound to other compounds such as its salts, ester, thioester or in free form or bound to other compounds such sugars or sugar polymers, like glucoside, e.g. diglucoside.

In particular it is known to the skilled that anionic compounds as acids are present in an equilibrium of the acid and its salts according to the pH present in the respective compartment of the cell or organism and the pK of the acid. Thus, the term "the fine chemical", the term "the respective fine chemical", the term "acid" or the use of a denomination referring to a neutralized anionic compound respectively relates the anionic form as well as the neutralised status of that compound.

Thus, specifically shikimic acid relates also to shikimate and vice versae and the terms are used interchangeably throughout the following description of the invention. In one embodiment, the term "the fine chemical" and the term "the respective fine chemical" mean at least one chemical compound with an activity of the abovementioned fine chemical.

Accordingly, the present invention relates to a process for the production of gamma-aminobutyric acid, which comprises (a) increasing or generating the activity of a protein as shown in table II, application no. 17a, column 3 encoded by the nucleic acid sequences as shown in table I, application no. 17a, column 5, in an organelle of a microorganism or plant, or
(b) increasing or generating the activity of a protein as shown in table II, application no. 17a, column 3 encoded by the nucleic acid sequences as shown in table I, application no. 17a, column 5 in the plastid of a microorganism or plant, or in one or more parts thereof; and
(c) growing the organism under conditions which permit the production of the fine chemical, thus, gamma-aminobutyric acid or fine chemicals comprising gamma-aminobutyric acid, in said organism or in the culture medium surrounding the organism.

Accordingly, the present invention relates to a process for the production of shikimate, which comprises (a) increasing or generating the activity of a protein as shown in table II, application no. 17b, column 3 encoded by the nucleic acid sequences as shown in table I, application no. 17b, column 5, in an organelle of a microorganism or plant, or
(b) increasing or generating the activity of a protein as shown in table II, application no. 17b, column 3 encoded by the nucleic acid sequences as shown in table I, application no. 17b, column 5 in the plastid of a microorganism or plant, or in one or more parts thereof; and
(c) growing the organism under conditions which permit the production of the fine chemical, thus, shikimate or fine chemicals comprising aminobutyric acid and/or putrescine and/or shikimate, in said organism or in the culture medium surrounding the organism.

Accordingly, the present invention relates to a process for the production of putrescine, which comprises (a) increasing or generating the activity of a protein as shown in table II, application no. 17c, column 3 encoded by the nucleic acid sequences as shown in table I, application no. 17c, column 5, in an organelle of a microorganism or plant, or
(b) increasing or generating the activity of a protein as shown in table II, application no. 17c, column 3 encoded by the nucleic acid sequences as shown in table I, application no. 17c, column 5 in the plastid of a microorganism or plant, or in one or more parts thereof; and
(c) growing the organism under conditions which permit the production of the fine chemical, thus, putrescine or fine chemicals comprising aminobutyric acid and/or putrescine and/or shikimate, in said organism or in the culture medium surrounding the organism.

Accordingly, the term "the fine chemical" means "gamma-aminobutyric acid" in relation to all sequences listed in table I, application no. 17a, columns 5 and 7 or homologs thereof. Accordingly, the term "the fine chemical" means "putrescine" in relation to all sequences listed in table I, application no. 17c, columns 5 and 7 or homologs thereof. Accordingly, the term "the fine chemical" means "shikimate" in relation to all sequences listed in table I, application no. 17b, columns 5 and 7 or homologs thereof.

Accordingly, the term "the fine chemical" can mean aminobutyric acid and/or putrescine and/or shikimate owing to circumstances and the context. Preferably the term "the fine chemical" means "shikimate". In order to illustrate that the meaning of the term "the respective fine chemical" means "aminobutyric acid and/or putrescine and/or shikimate" owing to the sequences listed in the context the term "the respective fine chemical" is also used.

Throughout the specification the term "the fine chemical" means aminobutyric acid and/or putrescine and/or shikimate, its salts, ester, thioester or in free form or bound to other compounds such sugars or sugar polymers, like glucoside, e.g. diglucoside.

In another embodiment the present invention is related to a process for the production of aminobutyric acid and/or putrescine and/or shikimate, which comprises (a) increasing or generating the activity of a protein as shown in table II, application no. 17, column 3 encoded by the nucleic acid sequences as shown in table I, application no. 17, column 5, in an organelle of a non-human organism, or
(b) increasing or generating the activity of a protein as shown in table II, application no. 17, column 3 encoded by the nucleic acid sequences as shown in table I, application no. 17, column 5, which are joined to a nucleic acid sequence encoding a transit peptide in a non-human organism, or in one or more parts thereof; or
(c) increasing or generating the activity of a protein as shown in table II, application no. 17, column 3 encoded by the nucleic acid sequences as shown in table I, application no. 17, column 5, which are joined to a nucleic acid sequence encoding chloroplast localization sequence, in a non-human organism, or in one or more parts thereof, and
(d) growing the organism under conditions which permit the production of gamma-aminobutyric acid and/or putrescine and/or shikimate in said organism. (Warum oben nach Metaboliten zerlegt und hier nicht??)

In another embodiment, the present invention relates to a process for the production of gamma-aminobutyric acid and/or putrescine and/or shikimate, which comprises (a) increasing or generating the activity of a protein as shown in table II, application no. 17, column 3 encoded by the nucleic acid sequences as shown in table I, application no. 17, column 5, in an organelle of a microorganism or plant through the transformation of the organelle, or
(b) increasing or generating the activity of a protein as shown in table II, application no. 17, column 3 encoded by the nucleic acid sequences as shown in table I, application no. 17, column 5 in the plastid of a microorganism or plant, or in one or more parts thereof through the transformation of the plastids; and
(c) growing the organism under conditions which permit the production of the fine chemical, thus, gamma-aminobutyric acid and/or putrescine and/or shikimate or fine chemicals comprising aminobutyric acid and/or putrescine and/or shikimate in said organism or in the culture medium surrounding the organism.

Advantageously the activity of the protein as shown in table II, application no. 17, column 3 encoded by the nucleic acid sequences as shown in table I, application no. 17, column 5 is increased or generated in the abovementioned process in the plastid of a microorganism or plant.

for the disclosure of the paragraphs [0019.0.0.16] to [0024.0.0.16] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 17, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 17, column 3 and its homologs as disclosed in table I, application no. 17, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 17, column 3 and its homologs as disclosed in table I, application no. 17, columns 5 and 7.

for the disclosure of the paragraphs [0027.0.0.16] to [0029.0.0.16] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 17, columns 5 and 7. The person skilled in the art is able to join said sequences in a functional manner. Advantageously the transit peptide part is cleaved off from the protein part shown in table II, application no. 17, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 17, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 17, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 17, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above. WO 2005/123929 (Plastid Transit Peptides) shows further transit peptides especially on pages 33 to 35, Tables 1 and two and in claim 1.

Alternatively to the targeting of the sequences shown in table II, application no. 17, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 17, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.16] and [0030.3.0.16] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 17, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 17, columns 5 and 7 or a sequence encoding a protein, as depicted in table II, application no. 17, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 17, columns 5 and 7 or a sequence encoding a protein, as depicted in table II, application no. 17, columns 5 and 7 in such a manner that the viroid sequence transports a sequence transcribed from a sequence as depicted in table I, application no. 17, columns 5 and 7 or a sequence encoding a protein as depicted in table II, application no. 17, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 17, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 17, columns 5 and 7.

In a preferred embodiment of the invention the nucleic acid sequences as shown in table I, application no. 17, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 17, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.16] and [0032.0.0.16] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 17, column 3. Preferably the modification of the activity of a protein as shown in table II, application no. 17, column 3 or their combination can be achieved by joining the protein to a transit peptide.

Surprisingly it was found, that the transgenic expression of the *Saccaromyces cerevisiae* protein as shown in table II, application no. 17, column 3 in plastids of a plant such as *Arabidopsis thalaiana* for example through the linkage to at least one targeting sequence for example as mentioned in table V conferred an increase in the fine chemical content of the transformed plants.

for the disclosure of this paragraph see paragraph [0035.0.0.0] above.

The sequence of b1704 (Accession number NP_416219) from *Escherichia coli* has been published in Blattner et al., Science 277 (5331), 1453-1474 (1997), and its activity is being defined as "3-deoxy-D-arabinoheptulosonate-7phosphate synthase (DAHP synthetase), tryptophan-repressible". Accordingly, in one embodiment, the process of the present invention comprises the use of a "3-deoxy-Darabinoheptulosonate-7-phosphate synthase (DAHP synthetase), tryptophanrepressible" or its homolog, e.g. as shown herein, for the production of the fine chemical, meaning of shikimic acid and/or salts, esters, thioestesr containing shikimic acid, in particular for increasing the amount of shikimic acidin free or bound form in an organism or a part thereof, as mentioned. In one embodiment, in the process of the present invention the activity of a b1704 protein is increased or generated, e.g. from *Escherichia coli* or a homolog thereof, preferably linked at least to one transit peptide as mentioned for example in table V. In a further embodiment, in the process of the present invention the activity of a b1704 protein is increased or generated, e.g. from *Escherichia coli* or a homolog thereof, preferably linked at least to one transit peptide as mentioned for example in WO 2005/123929 (Plastid Transit Peptides), which shows further transit peptides especially on pages 33 to 35, Tables 1 and two and in claim 1. In another embodiment, in the process of the present invention the activity of a b1704 protein is increased or generated in a subcellular compartment of the organism or organism cell such as in an organelle like a plastid or mitochondria.

The sequence of b1868 (Accession number PIR:D64949) from *Escherichia coli* has been published in Blattner et al., Science 277 (5331), 1453-1474 (1997), and its activity is being defined as "yecE protein". Accordingly, in one embodiment, the process of the present invention comprises the use of a "yecE protein" or its homolog, e.g. as shown herein, for the production of the fine chemical, meaning of shikimic acid and/or salts, esters, thioesters containing shikimic acid, in particular for increasing the amount of shikimic acid in free or bound form in an organism or a part thereof, as mentioned. In one embodiment, in the process of the present invention the activity of a b1868 protein is increased or generated, e.g. from *Escherichia coli* or a homolog thereof, preferably linked at least to one transit peptide as mentioned for example in table V. In a further embodiment, in the process of the present invention the activity of a b1868 protein is increased or generated, e.g. from *Escherichia coli* or a homolog thereof, preferably linked at least to one transit peptide as mentioned for example in WO 2005/123929 (Plastid Transit Peptides), which shows further transit peptides especially on pages 33 to 35, Tables 1 and two and in claim 1.

In another embodiment, in the process of the present invention the activity of a b1868 protein is increased or generated in a subcellular compartment of the organism or organism cell such as in an organelle like a plastid or mitochondria.

The sequence of b2600 (Accession number NP_417091) from *Escherichia coli* has been published in Blattner et al., Science 277 (5331), 1453-1474 (1997), and its activity is being defined as "bifunctional chorismate mutase/prephenate dehydrogenase". Accordingly, in one embodiment, the process of the present invention comprises the use of a "bifunctional chorismate mutase/prephenate dehydrogenase" or its homolog, e.g. as shown herein, for the production of the fine chemical, meaning of shikimic acid and/or salts, esters, thioesters containing shikimic acid, in particular for increasing the amount of shikimic acid in free or bound form in an organism or a part thereof, as mentioned. In one embodiment, in the process of the present invention the activity of a b2600protein is increased or generated, e.g. from *Escherichia coli* or a homolog thereof, preferably linked at least to one transit peptide as mentioned for example in table V. In a further embodiment, in the process of the present invention the activity of a b2600 protein is increased or generated, e.g. from *Escherichia coli* or a homolog thereof, preferably linked at least to one transit peptide as mentioned for example in WO 2005/123929 (Plastid Transit Peptides), which shows further transit peptides especially on pages 33 to 35, Tables 1 and two and in claim 1.

In another embodiment, in the process of the present invention the activity of a b2600protein is increased or generated in a subcellular compartment of the organism or organism cell such as in an organelle like a plastid or mitochondria.

The sequence of b2601 (Accession number NP_417092) from *Escherichia coli* has been published in Blattner et al., Science 277 (5331), 1453-1474 (1997), and its activity is being defined as "3-deoxy-D-arabinoheptulosonate-7-phosphate (DAHP) synthase". Accordingly, in one embodiment, the process of the present invention comprises the use of a "3-deoxy-D-arabinoheptulosonate-7-phosphate (DAHP) synthase" or its homolog, e.g. as shown herein, for the production of the fine chemical, meaning of shikimic acid and/or salts, esters, thioesters containing shikimic acid, in particular for increasing the amount of shikimic acid in free or bound form in an organism or a part thereof, as mentioned. In one embodiment, in the process of the present invention the activity of a b2601 protein is increased or generated, e.g. from *Escherichia coli* or a homolog thereof, preferably linked at least to one transit peptide as mentioned for example in table V. In a further embodiment, in the process of the present invention the activity of a b2601 protein is increased or generated, e.g. from *Escherichia coli* or a homolog thereof, preferably linked at least to one transit peptide as mentioned for example in WO 2005/123929 (Plastid Transit Peptides), which shows further transit peptides especially on pages 33 to 35, Tables 1 and two and in claim 1.

In another embodiment, in the process of the present invention the activity of a b2601 protein is increased or generated in a subcellular compartment of the organism or organism cell such as in an organelle like a plastid or mitochondria.

The sequence of b2965 (Accession number NP_417440) from *Escherichia coli* has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of putrescine and/or gamma-aminobutyric acid and/or salts, esters, thioesters containing putrescine and/or gamma-aminobutyric acid, in particular for increasing the amount of putrescine and/or gamma-aminobutyric acid in free or bound form in an organism or a part thereof, as mentioned. In one embodiment, in the process of the present invention the activity of a b2965 protein is increased or generated, e.g. from *Escherichia coli* or a homolog thereof, preferably linked at least to one transit peptide as mentioned for example in table V. In a further embodiment, in the process of the present invention the activity of a b2965 protein is increased or generated, e.g. from *Escherichia coli* or a homolog thereof, preferably linked at least to one transit peptide as mentioned for example in WO 2005/123929 (Plastid Transit Peptides), which shows further transit peptides especially on pages 33 to 35, Tables 1 and two and in claim 1.

In another embodiment, in the process of the present invention the activity of a b2965 protein is increased or generated in a subcellular compartment of the organism or organism cell such as in an organelle like a plastid or mitochondria.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase" which catalyzes the first step in aromatic amino acid biosynthesis and is feedback-inhibited by phenylalanine (Aro3p). Accordingly, in one embodiment, the process of the present invention comprises the use of a "3-deoxy-D-arabino-heptulosonate-7-phosphate (DAHP) synthase" or its homolog, e.g. as shown herein, for the production of the fine chemical, meaning of shikimic acid and/or salts, esters, thioesters containing shikimic acid, in particular for increasing the amount of shikimic acid in free or bound form in an organism or a part thereof, as mentioned. In one embodiment, in the process of the present invention the activity of a YDR035W protein is increased or generated, e.g.

from *Saccharomyces cerevisiae* or a homolog thereof, preferably linked at least to one transit peptide as mentioned for example in table V. In a further embodiment, in the process of the present invention the activity of a YDR035W protein is increased or generated, e.g. from *Saccharomyces cerevisiae* or a homolog thereof, preferably linked at least to one transit peptide as mentioned for example in WO 2005/123929 (Plastid Transit Peptides), which shows further transit peptides especially on pages 33 to 35, Tables 1 and two and in claim 1.

In another embodiment, in the process of the present invention the activity of a YDR035W protein is increased or generated in a subcellular compartment of the organism or organism cell such as in an organelle like a plastid or mitochondria.

The sequence of YOR350C (Accession number PIR|S67259) from *Saccharomyces cerevisiae* has been published in Goffeau et al., Science 274 (5287), 546-547, 1996 and Jacq et al., Nature 387 (6632 Suppl), 75-78 (1997), and its activity is being defined as similar to a "*Lucilia illustris* mitochondria cytochrome oxidase". Accordingly, in one embodiment, the process of the present invention comprises the use of a protein similar to a "*Lucilia illustris* mitochondria cytochrome oxidase" or its homolog, e.g. as shown herein, for the production of the fine chemical, meaning of shikimic acid and/or triglycerides, lipids, oils and/or fats containing shikimic acid, in particular for increasing the amount of shikimic acid in free or bound form in an organism or a part thereof, as mentioned. In one embodiment, in the process of the present invention the activity of a YOR350C protein is increased or generated, e.g. from *Saccharomyces cerevisiae* or a homolog thereof, preferably linked at least to one transit peptide as mentioned for example in table V. In a further embodiment, in the process of the present invention the activity of a YOR350C protein is increased or generated, e.g. from *Saccharomyces cerevisiae* or a homolog thereof, preferably linked at least to one transit peptide as mentioned for example in WO 2005/123929 (Plastid Transit Peptides), which shows further transit peptides especially on pages 33 to 35, Tables 1 and two and in claim 1. In another embodiment, in the process of the present invention the activity of a YOR350C protein is increased or generated in a subcellular compartment of the organism or organism cell such as in an organelle like a plastid or mitochondria.STOPP In one embodiment, the homolog of the b1704, b1868, b2600, b2601 and/or b2965 is a homolog having said activity and being derived from bacteria. In one embodiment, the homolog of the b1704, b1868, b2600, b2601 and/or b2965 is a homolog having said activity and being derived from Proteobacteria. In one embodiment, the homolog of the b1704, b1868, b2600, b2601 and/or b2965 is a homolog having said activity and being derived from Gammaproteobacteria. In one embodiment, the homolog of the b1704, b1868, b2600, b2601 and/or b2965 is a homolog having said activity and being derived from Enterobacteriales. In one embodiment, the homolog of the b1704, b1868, b2600, b2601 and/or b2965 is a homolog having said activity and being derived from Enterobacteriaceae. In one embodiment, the homolog of the b1704, b1868, b2600, b2601 and/or b2965 is a homolog having said activity and being derived from *Escherichia*, preferably from *Escherichia coli*.

In one embodiment, the homolog of YDR035W or YOR350C protein is a homolog having the same or a similar activity, in particular an increase of activity confers an increase in the content of the fine chemical in the organisms and being derived from an Eukaryot. In one embodiment, the homolog of YDR035W or YOR350C protein is a homolog having the same or a similar activity, in particular an increase of activity confers an increase in the content of the fine chemical in an organisms or part thereof, and being derived from Fungi. In one embodiment, the homolog of the YDR035W or YOR350C is a homolog having the same or a similar activity, in particular an increase of activity confers an increase in the content of the fine chemical in the organisms or a part thereof and being derived from Ascomycota. In one embodiment, the homolog of the YDR035W or YOR350C is a homolog having the same or a similar activity, in particular an increase of activity confers an increase in the content of the fine chemical in the organisms or part thereof, and being derived from *Saccharomycotina*, preferably *Saccharomycetes*, even more preferred from *Saccharomycetales, Saccharomycetaceae* and especially from *Saccharomycetes*.

for the disclosure of this paragraph see paragraph [0038.0.0.0] above.

In accordance with the invention, a protein or polypeptide has the "activity of an protein as shown in table II, application no. 17, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 17, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 17, column 3, or which has at least 10% of the original enzymatic activity, preferably 20%, particularly preferably 30%, most particularly preferably 40% in comparison to a protein as shown in table II, application no. 17, column 3 of *Saccharomyces cerevisiae*.

for the disclosure of the paragraphs [0040.0.0.16] to [0047.0.0.16] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 17, column 3 its biochemical or genetical causes and the increased amount of the fine chemical.

for the disclosure of the paragraphs [0049.0.0.16] to [0051.0.0.16] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 17, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.16] to [0058.0.0.16] see paragraphs [0053.0.0.0] to [0058.0.0.0] above.

In case the activity of the *Escherichia coli* protein b1704 or its homologs, e.g. a "3-deoxy-D-arabinoheptulosonate-7-phosphate synthase (DAHP synthetase), tryptophan-repressible" is increased advantageously in an organelle such as a plastid or mitochondria, preferably, in one embodiment an increase of the fine chemical, preferably of shikimic acid between 154% and 6593% or more is conferred.

In case the activity of the *Escherichia coli* protein b2601 or its homologs, e.g. a "3deoxy-D-arabinoheptulosonate-7-phosphate (DAHP) synthase" is increased advantageously in an organelle such as a plastid or mitochondria, preferably, in one embodiment an increase of the fine chemical, preferably of shikimic acid between 42% and 278% or more is conferred.

In case the activity of the *Escherichia coli* protein b1868or its homologs, e.g. a "yecE protein" is increased advantageously in an organelle such as a plastid or mitochondria, preferably, in one embodiment an increase of the fine chemical, preferably of shikimic acid between 20% and 108% or more is conferred.

In case the activity of the *Escherichia coli* protein b2600 or its homologs, e.g. a "bifunctional chorismate mutase/prephenate dehydrogenase" is increased advantageously in an organelle such as a plastid or mitochondria, preferably, in one embodiment an increase of the fine chemical, preferably of shikimic acid between 14% and 32% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of gamma-Aminobutyric acid (GABA) between 253% and 830% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of putrescine between 7224% and 132645% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of of gamma-Aminobutyric acid (GABA) between 253% and 830% or more and of putrescine between 7224% and 132645% or more is conferred.

In case the activity of the *Saccharomyces cerevisiae* protein YDR035W or its homologs, e.g. a "3-deoxy-D-arabino-heptulosonate 7-phosphate (DAHP) synthase" is increased advantageously in an organelle such as a plastid or mitochondria, preferably, in one embodiment an increase of the fine chemical, preferably of shikimic acid between 26% and 174% or more is conferred.

In case the activity of the *Saccharomyces cerevisiae* protein YOR350C or its homologs, e.g. a "protein similar to *Lucilia illustris* mitochondria cytochrome oxidase" is increased advantageously in an organelle such as a plastid or mitochondria, preferably, in one embodiment an increase of the fine chemical, preferably of shikimic acid between 14% and 15% or more is conferred.

% for the disclosure of the paragraphs [0061.0.0.116] and [0062.0.0.116] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 17, column 7 or of the polypeptide as shown in the amino acid sequences as disclosed in table II, application no. 17, columns 5 and 7 or the functional homologues thereof as described herein, or is encoded by the nucleic acid molecule characterized herein or the nucleic acid molecule according to the invention, for example by the nucleic acid molecule as shown in table I, application no. 17, columns 5 and 7 or its herein described functional homologues and has the herein mentioned activity.

/ for the disclosure of the paragraphs [0065.0.0.116] and [0066.0.0.116] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 17, columns 5 and 7 or its homologs activity having herein-mentioned gamma-aminobutyric acid and/or putrescine and/or shikimate increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 17, columns 5 and 7, e.g. a nucleic acid sequence encoding a polypeptide having the activity of a protein as indicated in table II, application no. 17, columns 5 and 7 or its homologs activity or of a mRNA encoding the polypeptide of the present invention having herein-mentioned gamma-aminobutyric acid and/or putrescine and/or shikimate increasing activity; and/or c) increasing the specific activity of a protein conferring the increased expression of a protein encoded by the nucleic acid molecule of the invention or of the polypeptide of the present invention having herein-mentioned gamma-aminobutyric acid and/or putrescine and/or shikimate increasing activity, e.g. of a polypeptide having the activity of a protein as indicated in table II, application no. 17, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned gamma-aminobutyric acid and/or putrescine and/or shikimate increasing activity, e.g. of a polypeptide having the activity of a protein as indicated in table II, application no. 17, columns 5 and 7 or its homologs activity; and/or e) stimulating activity of a protein conferring the increased expression of a protein encoded by the nucleic acid molecule of the present invention or a polypeptide of the present invention having herein-mentioned gamma-aminobutyric acid and/or putrescine and/or shikimate increasing activity, e.g. of a polypeptide having the activity of a protein as indicated in table II, application no. 17, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned gamma-aminobutyric acid and/or putrescine and/or shikimate increasing activity, e.g. of a polypeptide having the activity of a protein as indicated in table II, application no. 17, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned gamma-aminobutyric acid and/or putrescine and/or shikimate increasing activity, e.g. of a polypeptide having the activity of a protein as indicated in table II, application no. 17, columns 5 and 7 or its homologs activity; and/or h) increasing the expression of the endogenous gene encoding the polypeptide of the invention, e.g. a polypeptide having the activity of a protein as indicated in table II, application no. 17, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned gamma-aminobutyric acid and/or putrescine and/or shikimate increasing activity, e.g. of polypeptide having the activity of a protein as indicated in table II, application no. 17, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned gamma-aminobutyric acid and/or putrescine and/or shikimate increasing activity, e.g. of a polypeptide having the activity of a protein as indicated in table II, application no. 17, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned gamma-aminobutyric acid and/or putrescine and/or shikimate increasing activity, e.g. of a polypeptide having the activity of a protein as indicated in table II, application no. 17, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 17, column 3 or its homologs. Preferably the increase of the fine chemical takes place in plastids.

for the disclosure of the paragraphs [0069.0.0.116] to [0079.0.0.116] see paragraphs [0069.0.0.0] to [0079.0.0.0] above.

The activation of an endogenous polypeptide having above-mentioned activity, e.g. having the activity of a protein as shown in table II, application no. 17, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 17, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 17, column 3. The expression of the chimeric transcription factor in a organism, in particular in a plant, leads to a specific expression of the protein as shown in table II, application no. 17, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.16] to [0084.0.0.16] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous gamma-aminobutyric acid and/or putrescine and/or shikimate composition comprising a higher content of (from a viewpoint of nutritional physiology limited) gamma-aminobutyric acid and/or putrescine and/or shikimate.

for the disclosure of this paragraph see paragraph [0086.0.0.0] above.

By influencing the metabolism thus, it is possible to produce, in the process according to the invention, further advantageous compounds. Examples of such compounds are, in addition to gamma-aminobutyric acid and/or putrescine and/or shikimate, salts, esters, thioesters containing aminobutyric acid and/or putrescine and/or shikimate.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 17, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound gamma-aminobutyric acid and/or putrescine and/or shikimate.

for the disclosure of the paragraphs [0090.0.0.16] to see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 17, columns 5 and 7 or a derivative thereof, or
b) a genetic regulatory element, for example a promoter, which is functionally linked to the nucleic acid sequence as shown table I, application no. 17, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 17, columns 5 and 7 joined to a nucleic acid sequence encoding a transit peptide, or a targeting nucleic acid sequence which directs the nucleic acid sequences disclosed in table I, application no. 17, columns 5 and 7 to the organelle preferentially the plastids. Altenatively the inventive nucleic acids sequences consist advantageously of the nucleic acid sequences as depicted in the sequence protocol and disclosed in table I, application no. 17, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose gamma-aminobutyric acid and/or putrescine and/or shikimate content is modified advantageously owing to the nucleic acid molecule of the present invention expressed. This is important for plant breeders since, for example, the nutritional value of plants for poultry is dependent on the abovementioned gamma-aminobutyric acid and/or putrescine and/or shikimate and the general amount of gamma-aminobutyric acid and/or putrescine and/or shikimate as energy source and/or protecting compounds in feed. After the activity of the protein as shown in table II, application no. 17, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.16] to [0110.0.0.16] see paragraphs [0102.0.0.0] to [0110.0.0.0] above.

In a preferred embodiment, the fine chemical (gamma-aminobutyric acid and/or putrescine and/or shikimate) is produced in accordance with the invention and, if desired, is isolated. The production of further gamma-aminobutyric acid and/or putrescine and/or shikimate and mixtures thereof or mixtures of other fine chemicals by the process according to the invention is advantageous. It may be advantageous to increase the pool of free gamma-aminobutyric acid and/or putrescine and/or shikimate in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example another gene of the gamma-aminobutyric acid and/or putrescine and/or shikimate biosynthesis, or a compound, which functions as a sink for the desired gamma-aminobutyric acid and/or putrescine and/or shikimate in the organism is useful to increase the production of the respective fine chemical.

In a preferred embodiment, the respective fine chemical is produced in accordance with the invention and, if desired, is isolated. The production of further fine chemicals, or compounds for which the respective fine chemical is a biosynthesis precursor compounds, or mixtures thereof or mixtures of other fine chemicals, by the process according to the invention is advantageous.

In the case of the fermentation of microorganisms, the above-mentioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise gamma-aminobutyric acid and/or putrescine and/or shikimate synthesized in the process according to the invention can advantageously be marketed directly without there being any need for the gamma-aminobutyric acid and/or putrescine and/or shikimate synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

However, the respective fine chemical produced in the process according to the invention can also be isolated from the organisms, advantageously plants, in the form of their salts, esters, thioesters, as extracts, e.g. ether, alcohol, or other organic solvents or water containing extract and/or free gamma-aminobutyric acid and/or putrescine and/or shikimate. The respective fine chemical produced by this process can be obtained by harvesting the organisms, either from the medium in which they grow, or from the field. This can be done via pressing or extraction of the plant parts. To increase the efficiency of extraction it is beneficial to clean, to temper and if necessary to hull and to flake the plant material. E.g., salts, esters, thioesters comprising gamma-aminobutyric acid and/or putrescine and/or shikimate can be obtained by what is known as cold beating or cold pressing without applying heat. To allow for greater ease of disruption of the plant parts, specifically the seeds, they can previously be comminuted, steamed or roasted. Seeds, which have been pretreated in this manner can subsequently be pressed or extracted with solvents such as warm hexane. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid.

Because gamma-aminobutyric acid and/or putrescine and/ or shikimate in microorganisms are localized intracellular, their recovery essentials comes down to the isolation of the biomass. Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose. However, it can be advantageous to avoid this treatment as it can result in cells devoid of most carotenoids.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 1127-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Gamma-Aminobutyric acid and/or putrescine and/or shikimate can for example be detected advantageously via HPLC, LC or GC separation methods. The unambiguous detection for the presence of xanthophylls, in particular beta-cryptoxanthin or zeaxanthin containing products can be obtained by analyzing recombinant organisms using analytical standard methods: LC, LC-MS, MS or TLC). The material to be analyzed can be disrupted by sonication, grinding in a glass mill, liquid nitrogen and grinding, cooking, or via other applicable methods In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:
a) nucleic acid molecule encoding, preferably at least the mature form, of the polypeptide shown in table II, application no. 17, columns 5 and 7 or a fragment thereof, which confers an increase in the amount of the fine chemical in an organism or a part thereof;
b) nucleic acid molecule comprising, preferably at least the mature form, of the nucleic acid molecule shown in table I, application no. 17, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table III, application no. 17, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 17, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 17, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 17, columns 5 and 7 by one or more nucleotides. In one embodiment, the nucleic acid molecule used in the process of the invention does not consist of the sequence indicated in table IA, application no. 17, columns 5 and 7. In one embodiment, the nucleic acid molecule used in the process of the invention is less than 100%, 99.999%, 99.99%, 99.9% or 99% identical to a sequence indicated in table IA, application no. 17, columns 5 and 7. In another embodiment, the nucleic acid molecule does not encode a polypeptide of a sequence indicated in table IIA, application no. 17, columns 5 and 7.

In one embodiment, the nucleic acid molecule used in the process of the invention distinguishes over the sequence indicated in table IB, application no. 17, columns 5 and 7, by one or more nucleotides. In one embodiment, the nucleic acid molecule used in the process of the invention does not consist of the sequence indicated in table IB, application no. 17, columns 5 and 7. In one embodiment, the nucleic acid molecule used in the process of the invention is less than 100%, 99.999%, 99.99%, 99.9% or 99% identical to a sequence indicated in table IB, application no. 17, columns 5 and 7. In another embodiment, the nucleic acid molecule does not encode a polypeptide of a sequence indicated in table IIB, application no. 17, columns 5 and 7.

In one embodiment, the nucleic acid molecule used in the process distinguishes over the sequence shown in table I, application no. 17, columns 5 and 7 by one or more nucleotides or does not consist of the sequence shown in table I, application no. 17, columns 5 and 7. In one embodiment, the nucleic acid molecule of the present invention is less than 100%, 99.999%, 99.99%, 99.9% or 99% identical to the sequence shown in table I, application no. 17, columns 5 and 7. In another embodiment, the nucleic acid molecule does not encode a polypeptide of the sequence shown in table II, application no. 17, columns 5 and 7.

for the disclosure of the paragraphs [0118.0.0.16] to [0120.0.0.16] see paragraphs [0118.0.0.0] to [0120.0.0.0] above.

Nucleic acid molecules with the sequence shown in table I, application no. 17, columns 5 and 7, nucleic acid molecules which are derived from the amino acid sequences shown in table II, application no. 17, columns 5 and 7 or from polypeptides comprising the consensus sequence shown in table IV, application no. 17, column 7, or their derivatives or homologues encoding polypeptides with the enzymatic or biological activity of a protein as shown in table II, application no. 17, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 17, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 17, column 3 and conferring the fine chemical increase by expression either in the cytsol or in an organelle such as a plastid or mitochondria or both, preferably in plastids.

for the disclosure of the paragraphs [0126.0.0.16] to [0133.0.0.16] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 17, columns 5 and 7 or the functional homologues thereof as described herein, preferably conferring above-mentioned activity, i.e. conferring the fine chemical increase after increasing its activity, e.g. after increasing the activity of a protein as shown in table II, application no. 17, column 3 by for example expression either in the cytsol or in an organelle such as a plastid or mitochondria or both, preferably in plastids.

for the disclosure of the paragraphs [0135.0.0.16] to [0140.0.0.16] see paragraphs [0135.0.0.0] to [0140.0.0.0] above.

Synthetic oligonucleotide primers for the amplification, e.g. as shown in table III, application no. 17, column 7, by means of polymerase chain reaction can be generated on the basis of a sequence shown herein, for example the sequence shown in table I, application no. 17, columns 5 and 7 or the sequences derived from table II, application no. 17, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 17, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 17, column 3 or further functional homologs of the polypeptide of the invention from other organisms.

for the disclosure of the paragraphs [0144.0.0.16] to [0151.0.0.16] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 17, columns 5 and 7, preferably of table IB, application no. 17, columns 5 and 7 under relaxed hybridization conditions and which code on expression for peptides having the Gamma-aminobutyric acid and/or shikimate and/or putrescine or lipids, oils and/or fats containing Gamma-aminobutyric acid and/or shikimate and/or putrescine increasing activity.

for the disclosure of the paragraphs [0153.0.0.16] to [0159.0.0.16] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 17, columns 5 and 7, preferably shown in table IB, application no. 17, columns 5 and 7 is one which is sufficiently complementary to one of the nucleotide sequences shown in table I, application no. 17, columns 5 and 7, preferably shown in table IB, application no. 17, columns 5 and 7 such that it can hybridize to one of the nucleotide sequences shown in table I, application no. 17, columns 5 and 7, preferably shown in table IB, application no. 17, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 17, columns 5 and 7, preferably shown in table IB, application no. 17, columns 5 and 7, or a portion thereof and preferably has above mentioned activity, in particular having a fine chemical increasing activity after increasing the activity or an activity of a gene product as shown in table II, application no. 17, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 17, columns 5 and 7, preferably shown in table IB, application no. 17, columns 5 and 7, or a portion thereof and encodes a protein having above-mentioned activity, e.g. conferring of a Gamma-aminobutyric acid and/or shikimate and/or putrescine, triglycerides, lipids, oils and/or fats containing Gamma-aminobutyric acid and/or shikimate and/or putrescine increase by for example expression either in the cytsol or in an organelle such as a plastid or mitochondria or both, preferably in plastids, and optionally, the activity of a protein as shown in table II, application no. 17, column 3.

Moreover, the nucleic acid molecule of the invention can comprise only a portion of the coding region of one of the sequences shown in table I, application no. 17, columns 5 and 7, preferably shown in table IB, application no. 17, columns 5 and 7, for example a fragment which can be used as a probe or primer or a fragment-encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 17, columns 5 and 7, an anti-sense sequence of one of the sequences, e.g., set forth in table I, application no. 17, columns 5 and 7, preferably shown in table IB, application no. 17, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table II, application no. 17, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 17, columns 5 and 7 such that the protein or portion thereof maintains the ability to participate in the fine chemical production, in particular a Gamma-aminobutyric acid and/or shikimate and/or putrescine, triglycerides, lipids, oils and/or fats containing gamma-aminobutyric acid and/or putrescine and/or shikimate increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 17, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 17, columns 5 and 7 and having abovementioned activity, e.g. conferring preferably the increase of the fine chemical by for example expression either in the cytsol or in an organelle such as a plastid or mitochondria or both, preferably in plastids.

for the disclosure of the paragraphs [0168.0.0.16] and [0169.0.0.16] see paragraphs [0168.0.0.0] and [0169.0.0.0] above.

The invention further relates to nucleic acid molecules that differ from one of the nucleotide sequences shown in table I, application no. 17, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 17, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 17, columns 5 and 7 or the functional homologues. In a still further embodiment, the nucleic acid molecule of the invention encodes a full length protein which is substantially homologous to an amino acid sequence shown in table II, application no. 17, columns 5 and 7 or the functional homologues. However, in a preferred embodiment, the nucleic acid molecule of the present invention does not consist of the sequence shown in table I, application no. 17, columns 5 and 7, preferably as indicated in table IA, application no. 17, columns 5 and 7. Preferably the nucleic acid molecule of the invention is a functional homologue or identical to a nucleic acid molecule indicated in table IB, application no. 17, columns 5 and 7.

for the disclosure of the paragraphs [0171.0.0.16] to [0173.0.0.16] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 17, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 17, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 17, columns 5 and 7.

for the disclosure of the paragraphs [0179.0.0.16] and [0180.0.0.16] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 17, columns 5 and 7, preferably shown in table IIA, application no. 17, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 17, columns 5 and 7, preferably shown in table IIA, application no. 17, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 17, columns 5 and 7, preferably shown in table IIA, application no. 17, columns 5 and 7, more preferably at least about 70% identical to one of the sequences shown in table II, application no. 17, columns 5 and 7, preferably shown in table IIA, application no. 17, columns 5 and 7, even more preferably at least about 80%, 90%, 95% homologous to the sequence shown in table II, application no. 17, columns 5 and 7, preferably shown in table IIA, application no. 17, columns 5 and 7, and most preferably at least about 96%, 97%, 98%, or 99% identical to the sequence shown in table II, application no. 17, columns 5 and 7, preferably shown in table IIA, application no. 17, columns 5 and 7.

for the disclosure of the paragraphs [0182.0.0.16] to [0188.0.0.16] see paragraphs [0182.0.0.0] to [0188.0.0.0] above.

Functional equivalents derived from one of the polypeptides as shown in table II, application no. 17, columns 5 and 7, preferably shown in table IIB, application no. 17, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 17, columns 5 and 7, preferably shown in table IIB, application no. 17, columns 5 and 7 resp., according to the invention and are distinguished by essentially the same properties as the polypeptide as shown in table II, application no. 17, columns 5 and 7, preferably shown in table IIB, application no. 17, columns 5 and 7.

Functional equivalents derived from the nucleic acid sequence as shown in table I, application no. 17, columns 5 and 7, preferably shown in table IB, application no. 17, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 17, columns 5 and 7, preferably shown in table IIB, application no. 17, columns 5 and 7 resp., according to the invention and encode polypeptides having essentially the same properties as the polypeptide as shown in table II, application no. 17, columns 5 and 7, preferably shown in table IIB, application no. 17, columns 5 and 7.

for the disclosure of this paragraph see paragraph [0191.0.0.0] above.

A nucleic acid molecule encoding an homologous to a protein sequence of table II, application no. 17, columns 5 and 7, preferably shown in table IIB, application no. 17, columns 5 and 7 resp., can be created by introducing one or more nucleotide substitutions, additions or deletions into a nucleotide sequence of the nucleic acid molecule of the present invention, in particular of table I, application no. 17, columns 5 and 7, preferably shown in table IB, application no. 17, columns 5 and 7 resp., such that one or more amino acid substitutions, additions or deletions are introduced into the encoded protein. Mutations can be introduced into the encoding sequences of table I, application no. 17, columns 5 and 7, preferably shown in table IB, application no. 17, columns 5 and 7 resp., by standard techniques, such as site-directed mutagenesis and PCR-mediated mutagenesis.

for the disclosure of the paragraphs [0193.0.0.16] to [0196.0.0.16] see paragraphs [0193.0.0.0] to [0196.0.0.0] above.

Homologues of the nucleic acid sequences used, with the sequence shown in table I, application no. 17, columns 5 and 7, preferably shown in table IB, application no. 17, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 17, columns 5 and 7, preferably shown in table IB. application no. 17, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 17, columns 5 and 7, preferably shown in table IB, application no. 17, columns 5 and 7. It is preferred that the nucleic acid molecule comprises as little as possible other nucleotides not shown in any one of table I, application no. 17, columns 5 and 7, preferably shown in table IB, application no. 17, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 17, columns 5 and 7, preferably shown in table IB, application no. 17, columns 5 and 7.

Also preferred is that the nucleic acid molecule used in the process of the invention encodes a polypeptide comprising the sequence shown in table II, application no. 17, columns 5 and 7, preferably shown in table IIB, application no. 17, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 17, columns 5 and 7, preferably shown in table IIB, application no. 17, columns 5 and 7.

In one embodiment, the nucleic acid molecule of the invention or used in the process encodes a polypeptide comprising the sequence shown in table II, application no. 17, columns 5 and 7, preferably shown in table IIB, application no. 17, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 17, columns 5 and 7, preferably shown in table IB, application no. 17, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 17, columns 5 and 7 expressed under identical conditions.

Homologues of table I, application no. 17, columns 5 and 7 or of the derived sequences of table II, application no. 17, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.16] to [0215.0.0.16] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 17, columns 5 and 7, preferably in table IIB, application no. 17, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 17, columns 5 and 7, preferably in table IB, application no. 17, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 17, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 17, column 7 and conferring an increase in the amount of the fine chemical in an organism or a part thereof;

k) nucleic acid molecule encoding the amino acid sequence of a polypeptide encoding a domain of the polypeptide shown in table II, application no. 17, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 17, columns 5 and 7 or a nucleic acid molecule encoding, preferably at least the mature form of, the polypeptide shown in table II, application no. 17, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 17, columns 5 and 7 by one or more nucleotides. In one embodiment, the nucleic acid molecule of the invention does not consist of the sequence shown in table IA and/or IB, application no. 17, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 17, columns 5 and 7. In a further embodiment the nucleic acid molecule does not encode the polypeptide sequence shown in table IIA and/or IIB, application no. 17, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 17, columns 5 and 7 does not encode a protein of the sequence shown in table IIA and/or IIB, application no. 17, columns 5 and 7. Accordingly, in one embodiment, the protein encoded by a sequence of a nucleic acid accoriding to (a) to (l) does not consist of the sequence shown in table IA and/or IB, application no. 17, columns 5 and 7. In a further embodiment, the protein of the present invention is at least 30% identical to protein sequence depicted in table IIA and/or IIB, application no. 17, columns 5 and 7 and less than 100%, preferably less than 99.999%, 99.99% or 99.9%, more preferably less than 99%, 985, 97%, 96% or 95% identical to the sequence shown in table IIA and/or IIB, application no. 17, columns 5 and 7.

for the disclosure of the paragraphs [0217.0.0.16] to [0226.0.0.16] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in E. coli and in Agrobacterium. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 17, columns 5 and 7 can be cloned 3' prime to the transitpeptide encoding sequence, leading to a functional preprotein, which is directed to the plastids and which means that the mature protein fulfills its biological activity.

for the disclosure of the paragraphs [0228.0.0.16] to [0239.0.0.16] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 17, columns 5 and 7 or its derivatives, it is advantageous additionally to express and/or mutate further genes in the organisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 17, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins directly or indirectly involved in the glutamic acid or phosphoenolpyruvate metabolism. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the abovementioned biosynthesis genes are the sequences encoding further genes of the aromatic amino acid pathway, such as tryptophan, phenylalanine or tyrosine. These genes can lead to an increased synthesis of the essential amino acids tryptophan, phenylalanine or tyrosine.

In a further advantageous embodiment of the process of the invention, the organisms used in the process are those in which simultaneously a gamma-aminobutyric acid and/or shikimate and/or putrescine degrading protein is attenuated, in particular by reducing the rate of expression of the corresponding gene.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemcical and other xanthophylls produced by this process can be obtained by harvesting the organisms, either from the crop in which they grow, or from the field. This can be done via pressing or extraction of the plant parts.

Preferably, the compound is a composition comprising the essentially pure gamma-aminobutyric acid and/or shikimate and/or putrescine or a recovered or isolated gamma-aminobutyric acid and/or shikimate and/or putrescine, in particular, the respective fine chemical, free or in protein- and/or lipid-bound form.

for the disclosure of the paragraphs [0243.0.0.16] to [0264.0.0.16] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 17, columns 5 and 7 and described herein to achieve an expression in one of said compartments or extracellular.

for the disclosure of the paragraphs [0266.0.0.16] to [0287.0.0.16] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 17, columns 5 and 7 or their homologs is functionally linked to a plastidial targeting sequence. A further preferred embodiment of the invention relates to a vector in which a nucleic acid sequence encoding one of the polypeptides shown in table II, application no. 17, columns 5 and 7 or their homologs is functionally linked to a regulatory sequences which permit the expression in plastids.

for the disclosure of the paragraphs [0289.0.0.16] to [0296.0.0.16] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b1704, anti-b1868, anti-b2600, anti-b2601, anti-b2965, anti-YDR035W and/or anti-YOR350C protein antibody or an antibody against polypeptides as shown in table II, application no. 17, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 17, columns 5 and 7 or as coded by the nucleic acid molecule shown in table I, application no. 17, columns 5 and 7 or functional homologues thereof.

In one advantageous embodiment, in the method of the present invention the activity of a polypeptide is increased comprising or consisting of the consensus sequence shown in table IV, application no. 17, columns 7 and in one another embodiment, the present invention relates to a polypeptide comprising or consisting of the consensus sequence shown in table IV, application no. 17, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.16] to [0304.0.0.16] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 17, columns 5 and 7 by one or more amino acids. In one embodiment, polypeptide distinguishes form the sequence shown in table IIA and/or IIB, application no. 17, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 17, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 17, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 17, columns 5 and 7 by one or more amino acids. In another embodiment, said polypeptide of the invention does not consist of the sequence shown in table IIA and/or IIB, application no. 17, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 17, columns 5 and 7.

In one embodiment, the present invention relates to a polypeptide having the activity of the protein as shown in table IIA and/or IIB, application no. 17, column 3, which distinguishes over the sequence depicted in table IIA and/or IIB, application no. 17, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.16] to [0311.0.0.16] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 17, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 17, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 17, columns 5 and 7 or which is homologous thereto, as defined above.

Accordingly the polypeptide of the present invention can vary from the sequences shown in table IIA and/or IIB, application no. 17, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 17, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 17, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

above.

Manipulation of the nucleic acid molecule of the invention may result in the production of a protein having differences from the wild-type protein as shown in table II, application no. 17, column 3. Differences shall mean at least one amino acid different from the sequences as shown in table II, application no. 17, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 17, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 17, column 3. The nucleic acid molecules and polypeptide molecules of the invention are expressed such that the yield, production, and/or efficiency of production of a desired compound is improved.

for the disclosure of the paragraphs [0320.0.0.16] to [0322.0.0.16] see paragraphs [0320.0.0.0] to [0322.0.0.0] above.

In one embodiment, a protein (=polypeptide) as shown in table II, application no. 17, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 17, column 3, e.g., a protein which does not confer the activity described herein and which is derived from the same or a different organism.

for the disclosure of the paragraphs [0324.0.0.16] to [0329.0.0.16] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 17, columns 5 and 7.

for the disclosure of the paragraphs [0331.0.0.16] to [0346.0.0.16] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 17, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 17, column 3 or a protein as shown in table II, application no. 17, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 17, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.16] to [0358.0.0.16] see paragraphs [0350.0.0.0] to [0358.0.0.0] above.

Transgenic plants comprising the gamma-aminobutyric acid and/or putrescine and/or shikimate synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The gamma-aminobutyric acid and/or putrescine and/or shikimate produced in the process according to the invention may, however, also be isolated from the plant in the form of their free gamma-aminobutyric acid and/or putrescine and/or shikimate, salts esters, thioesters containing said produced gamma-aminobutyric acid and/or putrescine and/or shikimate or gamma-aminobutyric acid and/or putrescine and/or shikimate bound to proteins. Gamma-aminobutyric acid and/or putrescine and/or shikimate produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

for the disclosure of the paragraphs [0360.0.0.16] to [0362.0.0.16] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the gamma-aminobutyric acid and/or shikimate and/or putrescine produced in the process can be isolated. The resulting gamma-aminobutyric acid and/or shikimate and/or putrescine can, if appropriate, subsequently be further purified, if desired mixed with other active ingredients such as vitamins, amino acids, carbohydrates, antibiotics and the like, and, if appropriate, formulated.

In one embodiment, gamma-aminobutyric acid, putrescine and shikimate, preferably gamma-aminobutyric acid and putrescine are a mixture of the respective fine chemicals.

The gamma-aminobutyric acid and/or shikimate and/or putrescine obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of pharmaceuticals, food stuff, animal feeds, nutrients or cosmetics comprising the steps of the process according to the invention, including the isolation of the gamma-aminobutyric acid and/or shikimate and/or putrescine composition produced or the respective fine chemical produced if desired and formulating the product with a pharmaceutical acceptable carrier or formulating the product in a form acceptable for an application in agriculture.

A further embodiment according to the invention is the use of the gamma-aminobutyric acid and/or shikimate and/or putrescine produced in the process or of the transgenic organisms in animal feeds, foodstuffs, medicines, food supplements, cosmetics or pharmaceuticals or for the production of gamma-aminobutyric acid and/or shikimate and/or putrescine e.g. after isolation of the respective fine chemical or without, e.g. in situ, e.g. in the organism used for the process for the production of the respective fine chemical.

Accordingly, the present invention relates a method for the production of pharmaceuticals, food stuff, animal feeds, nutrients or cosmetics comprising the steps of the process according to the invention, including the isolation of the shikimate composition produced or the respective fine chemical produced if desired and formulating the product with a pharmaceutical acceptable carrier or formulating the product in a form acceptable for an application in pharmacy. The production of shikimic acid by microbials has been already described in WO 02/29078, which is in incorporated herewith in its entirety, especially examples 1 and 2. In a preferred embodiment the shikimic acid is produced according to a process of the present invention in plants.

A further embodiment of the present invention is the use of the coding sequences according to table Nr. 17 b for the production of pharmaceuticals, especially of antivirals, even more preferred of antivirals against the avain influenza, especially preferred of Tamiflu®.

A further embodiment of the present invention is the use of shikimic acid produced by a method of the present invention for the production of pharmaceuticals, especially of antivirals, even more preferred of antivirals against the avain influenza, especially preferred of Tamiflu®.

A further embodiment of the present invention is the use of shikimic acid produced by a method of the present invention in plants for the production of pharmaceuticals, especially of antivirals, even more preferred of antivirals against the avain influenza, especially preferred of Tamiflu®.

for the disclosure of the paragraphs [0366.0.0.16] to [0369.0.0.16] see paragraphs [0366.0.0.0] to [0369.0.0.0] above.

The fermentation broths obtained in this way, containing in particular gamma-aminobutyric acid and/or shikimate and/or putrescine in mixtures with other organic acids, aminoacids, polypeptides or polysaccharides, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the gamma-aminobutyric acid and/or shikimate and/or putrescine produced according to the invention further. For this purpose, the product-containing compositions subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.16] to [0376.0.0.16], [0376.1.0.16] and [0377.0.0.16] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 17, columns 5 and 7, preferably in table IB, application no. 17, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and (f) identifying the nucleic acid molecule and its gene product which expression confers an increase in the the fine chemical level in the host cell after expression compared to the wild type.

for the disclosure of the paragraphs [0379.0.0.16] to [0383.0.0.16] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 17, column 3, e.g. comparing near identical organisms with low and high activity of the proteins as shown in table II, application no. 17, column 3.

for the disclosure of the paragraphs [0385.0.0.16] to [0404.0.0.16] see paragraphs [0385.0.0.0] to [0404.0.0.0] above.

Accordingly, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical or of the respective fine chemical and one or more other non-protein amino acids or organic acids. Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the antagonist identified with the method of the invention, the antibody of the present invention, the antisense molecule of the present invention, can be used for the reduction of the respective fine chemical in a organism or part thereof, e.g. in a cell.

for the disclosure of the paragraphs [0406.0.0.16] to [0435.0.0.16] see paragraphs [0406.0.0.0] to [0435.0.0.0] above.

Production of gamma-aminobutyric acid and/or shikimate and/or putrescine, salts, esters, thioesters containing gamma-aminobutyric acid and/or shikimate and/or putrescine in *Chlamydomonas reinhardtii*

The gamma-aminobutyric acid and/or shikimate and/or putrescine-production can be analysed as mentioned herein.

The proteins and nucleic acids can be analysed as mentioned below.

for the disclosure of the paragraphs [0437.0.0.16] and [0438.0.0.16] see paragraphs [0437.0.0.0] and [0438.0.0.0] above.

Example 9

Analysis of the Effect of the Nucleic Acid Molecule on the Production of Gamma-Aminobutyric Acid and/or Shikimate and/or Putrescine The effect of the genetic modification of plants or algae on the production of a desired compound (such as gamma-aminobutyric acid and/or shikimate and/or putrescine) can be determined by growing the modified plant under suitable conditions (such as those described above) and analyzing the medium and/or the cellular components for the elevated production of desired product (i.e. of the gamma-aminobutyric acid and/or shikimate and/or putrescine). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter II, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of aminobutyric acid and/or putrescine and/or shikimate:

Abbreviations; GC-MS, gas liquid chromatography/mass spectrometry; TLC, thin-layer chromatography.

The unambiguous detection for the presence of aminobutyric acid and/or putrescine and/or shikimate can be obtained by analyzing recombinant organisms using analytical standard methods: GC, GC-MS, LC, LC-MSMS or TLC, as described. The total amount produced in the organism for example in yeasts used in the inventive process can be analysed for example according to the following procedure:

The material such as yeasts, *E. coli* or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total extraction using such polar organic solvents as acetone or alcohols as methanol, or ethers, saponification, partition between phases, separation of non-polar epiphase from more polar hypophasic derivatives and chromatography.

For analysis, solvent delivery and aliquot removal can be accomplished with a robotic system comprising a single injector valve Gilson 232XL and a 4022S1V diluter [Gilson, Inc. USA, 3000 W. Beltline Highway, Middleton, Wis.]. For saponification, 3 ml of 50% potassium hydroxide hydro-ethanolic solution (4 water-1 ethanol) can be added to each vial, followed by the addition of 3 ml of octanol. The saponification treatment can be conducted at room temperature with vials maintained on an IKA HS 501 horizontal shaker [Labworld-online, Inc., Wilmington, N.C.] for fifteen hours at 250 movements/minute, followed by a stationary phase of approximately one hour.

Following saponification, the supernatant can be diluted with 0.17 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol: 4 water: 15 tetrahydrofuran (THF) stabilized with 0.2% BHT (2,6-di-tert-butyl-4-methylphenol). Injections were 20 µl. Separation can be isocratic at 30° C. with a flow rate of 1.7 ml/minute. The peak responses can be measured by absorbance at 447 nm.

If required and desired, further chromatography steps with a suitable resin may follow. Advantageously, the aminobutyric acid and/or putrescine and/or shikimate can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

% for the disclosure of the paragraphs [0446.0.0.16] to [0496.0.0.16] see paragraphs [0446.0.0.0] to [0496.0.0.0] above.

As an alternative, the gamma-aminobutyric acid and/or shikimate and/or putrescine can be detected advantageously via HPLC separation in combination with NMR techniques for the structure clarification or in combination with mass spectrometry in case of small sample volumes as described for example by Karsten Putzbach (Theses, 2005 at the Eberhard-Karls-University of Tuebingen, Department of Chemistry and Pharmacy) or Mueller, H. Z. Lebensm. Unters. Forsch. A 204, 1997: 88-94.

As an alternative, gamma-aminobutyric acid can be detected as described in Haak and Reineke, Antimicrob. Agents Chemother. 19(3): 493(1981)

As an alternative, shikimate can be detected as described in Gould and Erickson, J Antibiot 41(5), 688-9 (1988).

As an alternative, putrescine can be detected as described in Endo Y., Anal Biochem. 89(1):235-46(1978).

The results of the different plant analyses can be seen from the table, which follows:

TABLE VI

| ORF | Metabolite | Method | Min | Max |
| --- | --- | --- | --- | --- |
| b1704 | Shikimic acid | GC | 2.54 | 66.93 |
| b1868 | Shikimic acid | GC | 1.20 | 2.08 |
| b2600 | Shikimic acid | GC | 1.14 | 1.32 |
| b2601 | Shikimic acid | GC | 1.42 | 3.78 |
| b2965 | Putrescine | GC | 73.24 | 1327.45 |
| b2965 | gamma-Aminobutyric acid (GABA) | GC | 3.53 | 9.30 |
| YDR035W | Shikimic acid | GC | 1.26 | 2.74 |
| YOR350C | Shikimic acid | GC | 1.14 | 1.15 | for the disclosure of the paragraphs [0499.0.0.16] and [0500.0.0.16] see paragraphs [0499.0.0.0] and [0500.0.0.0] above.

Example 15a

Engineering Ryegrass Plants by Over-Expressing b1704, b1868, b2600, b2601, b2965, YDR035W or YOR350C from *Escherichia coli* or Homologs of b1704, b1868, b2600, b2601, b2965, YDR035W or YOR350C from Other Organisms for the disclosure of the paragraphs [0502.0.0.16] to [0508.0.0.16] see paragraphs [0502.0.0.0] to [0508.0.0.0] above.

Example 15b

Engineering Soybean Plants by Over-Expressing b1704, b1868, b2600, b2601, b2965, YDR035W or YOR350C from *Escherichia coli* or Homologs of b1704, b1868, b2600, b2601, b2965, YDR035W or YOR350C from Other Organisms for the disclosure of the paragraphs [0510.0.0.16] to [0513.0.0.16] see paragraphs [0510.0.0.0] to [0513.0.0.0] above.

Example 15c

Engineering Corn Plants by Over-Expressing b1704, b1868, b2600, b2601, b2965, YDR035W or YOR350C from *Escherichia coli* or Homologs of b1704, b1868, b2600, b2601, b2965, YDR035W or YOR350C from Other Organisms for the disclosure of the paragraphs [0515.0.0.16] to see paragraphs [0515.0.0.0] to [0540.0.0.0] above.

Example 15d

Engineering Wheat Plants by Over-Expressing b1704, b1868, b2600, b2601, b2965, YDR035W or YOR350C from *Escherichia coli* or Homologs of b1704, b1868, b2600, b2601, b2965, YDR035W or YOR350C from Other Organisms for the disclosure of the paragraphs [0542.0.0.16] to see paragraphs [0542.0.0.0] to [0544.0.0.0] above.

Example 15e

Engineering Rapeseed/Canola Plants by Over-expressing b1704, b1868, b2600, b2601, b2965, YDR035W or YOR350C from *Escherichia coli* or Homologs of b1704, b1868, b2600, b2601, b2965, YDR035W or YOR350C from Other Organisms for the disclosure of the paragraphs [0546.0.0.16] to see paragraphs [0544.0.0.0] to [0549.0.0.0] above.

Example 15f

Engineering Alfalfa Plants by Over-Expressing b1704, b1868, b2600, b2601, b2965, YDR035W or YOR350C from *Escherichia coli* or Homologs of b1704, b1868, b2600, b2601, b2965, YDR035W or YOR350C from Other Organisms for the disclosure of the paragraphs [0551.0.0.16] to see paragraphs [0551.0.0.0] to [0554.0.0.0] above.

[0554.1.16.16]: *Zea mays* plants were engineered as described in Example 15c.

Metabolic results were either obtained from regenerated primary transformants (T0) or from the following progeny generation (T1) in comparison to appropriate control plants. The results are shown in table VII as minimal (MIN) or maximal changes (MAX) in the respective fine chemical (column "metabolite") in genetically modified corn plants expressing the sequence listed in column 1 (ORF):

TABLE VII

| ORF | Metabolite | Min | Max |
|---|---|---|---|
| b1704 | Shikimate | 2.58 | 4.32 |
| b2601 | Shikimate | 3.02 | 13.69 |
| YDR035W | Shikimate | 2.94 | 3.15 |

Table VII describes the increase in shikimate in genetically modified corn plants expressing the *Escherichia coli* nucleic acid sequences b2601, b1704 or *Saccharomyces cerevisiae* nucleic acid sequence YDR035W.

In case the activity of the *Saccharomyces cerevisiae* protein YDR035W or a protein with an 3-deoxy-D-arabino-heptulosonate 7-phosphate (DAHP) synthase activity or its homolog, is increased in corn plants, preferably, an increase of the fine chemical shikimate between 194% and 215% or more is conferred.

In case the activity of the *Escherichia coli* protein b2601 or a protein with an 3-deoxy-D-arabinoheptulosonate-7-phosphate (DAHP) synthase activity or its homolog, is increased in corn plants, preferably, an increase of the fine chemical shikimate between 202% and 1269% or more is conferred.

In case the activity of the *Escherichia coli* protein b1704 or a protein with an 3-deoxy-D-arabinoheptulosonate-7-phosphate synthase (DAHP synthetase), tryptophan-repressible activity or its homolog, is increased in corn plants, preferably, an increase of the fine chemical shikimate between 158% and 332% or more is conferred.

for the disclosure of this paragraph see [0554.2.0.0] above.
for the disclosure of this paragraph see [0555.0.0.0] above.
for the disclosure of this paragraph see [0001.0.0.0].

Coenzymes are molecules that cooperate in the catalytic action of an enzyme. Like enzymes, coenzymes are not irreversibly changed during catalysis; they are either unmodified or regenerated. Each kind of coenzyme has a particular chemical function. Coenzymes may either be attached by covalent bonds to a particular enzyme or exist freely in solution, but in either case they participate intimately in the chemical reactions catalyzed by the enzyme.

Coenzyme Q10 (CoQ 10) or ubiquinone is essentially a vitamin or vitamin-like substance. Disagreements on nomenclature notwithstanding, vitamins are defined as organic compounds essential in minute amounts for normal body function acting as coenzymes or precursors to coenzymes. Coenzyme Q10 or CoQ10 belongs to a family of substances called ubiquinones. Ubiquinones, also known as coenzymes Q and mitoquinones, are lipophilic, water-insoluble substances involved in electron transport and energy production in mitochondria. The basic structure of ubiquinones consists of a benzoquinone "head" and a terpinoid "tail." The "head" structure participates in the redox activity of the electron transport chain. The major difference among the various coenzymes Q is in the number of isoprenoid units (5-carbon structures) in the "tail." Coenzymes Q contain one to 12 isoprenoid units in the "tail"; 10 isoprenoid units are common in animals. Coenzymes Q occur in the majority of aerobic organisms, from bacteria to plants and animals. Two numbering systems exist for designation of the number of isoprenoid units in the terpinoid "tail": coenzyme Qn and coenzyme Q(x). N refers to the number of isoprenoid side chains, and x refers to the number of carbons in the terpinoid "tail" and can be any multiple of five. Thus, coenzyme Q10 refers to a coenzyme Q having 10 isoprenoid units in the "tail." Since each isoprenoid unit has five carbons, coenzyme Q10 can also be designated coenzyme Q(50). The structures of coenzymes Q are analogous to those of vitamin K2. Coenzyme Q10 is also known as Coenzyme Q(50), CoQ10, CoQ(50), ubiquinone (50), ubiquinol-10 and ubidecarerone.

They are present naturally in foods and sometimes are also synthesized in the body. CoQ10 likewise is found in small amounts in a wide variety of foods and is synthesized in all tissues. The biosynthesis of CoQ10 from the amino acid tyrosine is a multistage process requiring at least eight vitamins and several trace elements. Coenzymes are cofactors upon which the comparatively large and complex enzymes absolutely depend for their function. Coenzyme Q10 is the coenzyme for at least three mitochondrial enzymes (complexes I, II and III) as well as enzymes in other parts of the cell. Mitochondrial enzymes of the oxidative phosphorylation pathway are essential for the production of the high-energy phosphate, adenosine triphosphate (ATP), upon which all cellular functions depend. The electron and proton transfer functions of the quinone ring are of fundamental importance to all life forms; ubiquinone in the mitochondria of animals, plastoquinone in the chloroplast of plants, and menaquinone in bacteria. The term "bioenergetics" has been used to describe the field of biochemistry looking specifically at cellular energy production. In the related field of free radical chemistry, CoQ10 has been studied in its reduced form as a potent antioxidant. The bioenergetics and free radical chemistry of CoQ10 are reviewed in Gian Paolo Littarru's book, Energy and Defense, published in 1994. The precise chemical structure of CoQ10 is 2,3 dimethoxy-5 methyl-6 decaprenyl benzoquinone Discovered in 1957, CoQ-10 is also called ubiquinone because it belongs to a class of compounds called quinones, and because it's ubiquitous in living organisms, especially in the heart, liver, and kidneys. It plays a crucial role in producing energy in cells. And it acts as a powerful antioxidant, meaning that it helps neutralize cell-damaging molecules called free radicals. Manufactured by all cells in the body, CoQ-10 is also found in small amounts in foods, notably meat and fish. By the mid-1970's, the industrial technology to produce pure CoQ10 in quantities sufficient for larger clinical trials was established. Principally CoQ10 can be isolated from microorganisms or plants or algae; in particular mitochondria are a common source for CoQ10. Alternatively, they are obtained advantageously from animals or fish.

Since the actions of supplemental CoQ10 have yet to be clarified, the mechanism of these actions is a matter of speculation. However, much is known about the biochemistry of CoQ10. CoQ10 is an essential cofactor in the mitochondrial electron transport chain, where it accepts electrons from complex I and II, an activity that is vital for the production of ATP. CoQ10 has antioxidant activity in mitochondria and cellular membranes, protecting against peroxidation of lipid membranes. It also inhibits the oxidation of LDL-cholesterol. LDL-cholesterol oxidation is believed to play a significant role in the pathogenesis of atherosclerosis. CoQ10 is biosynthesized in the body and shares a common synthetic pathway with cholesterol.

CoQ10 levels decrease with aging in humans. Why this occurs is not known but may be due to decreased synthesis and/or increased lipid peroxidation which occurs with aging. Significantly decreased levels of CoQ10 have been noted in a wide variety of diseases in both animal and human studies. CoQ10 deficiency may be caused by insufficient dietary CoQ10, impairment in CoQ10 biosynthesis, excessive utilization of CoQ10 by the body, or any combination of the three. Decreased dietary intake is presumed in chronic malnutrition and cachexia.

The relative contribution of CoQ10 biosynthesis versus dietary CoQ10 is under investigation. Karl Folkers takes the position that the dominant source of CoQ10 in man is biosynthesis. This complex, 17 step process, requiring at least seven vitamins (vitamin B2-riboflavin, vitamin B3-niacinamide, vitamin B6, folic acid, vitamin B12, vitamin C, and pantothenic acid) and several trace elements, is, by its nature, highly vulnerable. Karl Folkers argues that suboptimal nutrient intake in man is almost universal and that there is subsequent secondary impairment in CoQ10 biosynthesis. This would mean that average or "normal" levels of CoQ10 are really suboptimal and the very low levels observed in advanced disease states represent only the tip of a deficiency "ice berg".

Supplemental CoQ10 may have cardioprotective, cytoprotective and neuroprotective activities. There are claims that it has positive effects in cancer, muscular dystrophy and immune dysfunction. Similarly, it may inhibit obesity or enhance athletic performance.

HMG-CoA reductase inhibitors used to treat elevated blood cholesterol levels by blocking cholesterol biosynthesis also block CoQ10 biosynthesis. The resulting lowering of blood CoQ10 level is due to the partially shared biosynthetic pathway of CoQ10 and cholesterol. In patients with heart failure this is more than a laboratory observation. It has a significant harmful effect which can be negated by oral CoQ10 supplementation.

Increased body consumption of CoQ10 is the presumed cause of low blood CoQ10 levels seen in excessive exertion, hypermetabolism, and acute shock states. It is likely that all three mechanisms (insufficient dietary CoQ10, impaired CoQ10 biosynthesis, and excessive utilization of CoQ10) are operable to varying degrees in most cases of observed CoQ10 deficiency.

In nature, Coenzymes Q0 to Q9 are found as well. E.g. Coenzyme Q9 is a derivative of CoQ10 found e.g. in the chloroplast of plants. Coenzyme Q9 has a shorter aliphatic group bound to the ring structure. Due to the high structural homology of Coenzymes Q0 to Q9 are expected to provide the same or very similar activities as CoQ10 in cells or organisms. However, Matsura et al., Biochim Biophys Acta, 1992, 1123 (3) pp. 309-15 concluded from their study that CoQ9 constantly acts as a potential antioxidant in hepatocytes whereas CoQ10 manly exhibit its antioxidant activity in cells containing CoQ10 as the predominate CoQ homolog. Coenzyme Q10 is actual a very common ingredient in different types of cosmetics, due to its protective role against radicals and its predicted function in skin tautening.

Thus, Coenzymes, in particular CoQ11 or CoQ9 can be used in a lot of different applications, for example in cosmetics, pharmaceuticals and in feed and food.

Therefore improving the productivity of said Coenzymes and improving the quality of cosmetics, pharmaceuticals, foodstuffs and animal feeds, in particular of nutrition supplements, is an important task of the different industries.

To ensure a high productivity of said Coenzymes in plants or microorganism, it is necessary to manipulate the natural biosynthesis of said Coenzymes in said organisms.

Accordingly, there is still a great demand for new and more suitable genes which encode enzymes or other regulators which participate in the biosynthesis of said Coenzymes and make it possible to produce said Coenzymes specifically on an industrial scale without that unwanted byproducts are formed. In the selection of genes for biosynthesis two characteristics above all are particularly important. On the one hand, there is as ever a need for improved processes for obtaining the highest possible contents of said Coenzymes on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is Coenzyme Q9 and/or Coenzyme Q10 in free or bound form for example bound to lipids, oils or fatty acids. Accordingly, in the present invention, the term "the fine chemical" as used herein relates to "Coenzyme Q9 and/or Coenzyme Q10 in free or bound form". Further, the term "the fine chemicals" as used herein also relates to fine chemicals comprising Coenzyme Q9 and/or Coenzyme Q10 in free or bound form.

In one embodiment, the term "Coenzyme Q9 and/or Coenzyme Q10 in free or bound form", "the fine chemical" or "the respective fine chemical" means at least one chemical compound selected from the group consisting of Coenzyme Q9, Coenzyme Q10 or mixtures thereof in free or bound form. Throughout the specification the term "the fine chemical" or "the respective fine chemical" means a compound selected from the group Coenzyme Q9, Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids.

In one embodiment, the term "the fine chemical" and the term "the respective fine chemical" mean at least one chemical compound with an activity of the abovementioned fine chemical.

In one embodiment, the term "the fine chemical" and the term "the respective fine chemical" mean at least one chemical compound with an activity of the above mentioned fine chemical Accordingly, the present invention relates to a process for the production of Coenzyme Q9 and/or Coenzyme Q10, which comprises
(a) increasing or generating the activity of a protein as shown in table II, application no. 18, column 3 encoded by the nucleic acid sequences as shown in table I, application no. 18, column 5, in an organelle of a microorganism or plant, or
(b) increasing or generating the activity of a protein as shown in table II, application no. 18, column 3 encoded by the nucleic acid sequences as shown in table I, application no. 18, column 5 in the plastid of a microorganism or plant, or in one or more parts thereof; and
(c) growing the organism under conditions which permit the production of the fine chemical, thus, Coenzyme Q9 and/or Coenzyme Q10 or fine chemicals comprising Coenzyme Q9 and/or Coenzyme Q10, are produced in said organism or in the culture medium surrounding the organism.

Accordingly, the term "the fine chemical" means "Coenzyme Q9 and/or Coenzyme Q10" in relation to all sequences listed in table I, application no. 18, columns 3 and 7 or homologs thereof. Accordingly, the term "the fine chemical" can mean "Coenzyme Q9 and/or Coenzyme Q10", owing to circumstances and the context. Preferably the term "the fine chemical" means "Coenzyme Q9 and/or Coenzyme Q10". In order to illustrate that the meaning of the term "the respective fine chemical" means "Coenzyme Q9 and/or Coenzyme Q10 in free or bound form" owing to the sequences listed in the context the term "the respective fine chemical" is also used.

In another embodiment the present invention is related to a process for the production of Coenzyme Q9 and/or Coenzyme Q10, which comprises
(a) increasing or generating the activity of a protein as shown in table II, application no. 18, column 3 encoded by the nucleic acid sequences as shown in table I, application no. 18, column 5, in an organelle of a non-human organism, or
(b) increasing or generating the activity of a protein as shown in table II, application no. 18, column 3 encoded by the nucleic acid sequences as shown in table I, application no. 18, column 5, which are joined to a nucleic acid sequence encoding a transit peptide in a non-human organism, or in one or more parts thereof; or
(c) increasing or generating the activity of a protein as shown in table II, application no. 18, column 3 encoded by the nucleic acid sequences as shown in table I, application no. 18, column 5, which are joined to a nucleic acid sequence encoding chloroplast localization sequence, in a non-human organism, or in one or more parts thereof, and
(d) growing the organism under conditions which permit the production of Coenzyme Q9 and/or Coenzyme Q10 in said organism.

In another embodiment, the present invention relates to a process for the production of Coenzyme Q9 and/or Coenzyme Q10, which comprises
(a) increasing or generating the activity of a protein as shown in table II, application no. 18, column 3 encoded by the nucleic acid sequences as shown in table I, application no. 18, column 5, in an organelle of a microorganism or plant through the transformation of the organelle, or
(b) increasing or generating the activity of a protein as shown in table II, application no. 18, column 3 encoded by the nucleic acid sequences as shown in table I, application no. 18, column 5 in the plastid of a microorganism or plant, or in one or more parts thereof through the transformation of the plastids; and
(c) growing the organism under conditions which permit the production of the fine 30 chemical, thus, Coenzyme Q9 and/or Coenzyme Q10 or fine chemicals comprising Coenzyme Q9 and/or Coenzyme Q10 in said organism or in the culture medium surrounding the organism.

Advantageously the activity of the protein as shown in table II, application no. 18, column 3 encoded by the nucleic acid sequences as shown in table I, application no. 18, column 5 is increased or generated in the abovementioned process in the plastid of a microorganism or plant.

for the disclosure of the paragraphs [0019.0.0.17] to [0024.0.0.17] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 18, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 18, column 3 and its homologs as disclosed in table I, application no. 18, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 18, column 3 and its homologs as disclosed in table I, application no. 18, columns 5 and 7.

for the disclosure of the paragraphs [0027.0.0.17] to [0029.0.0.17] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 18, columns 5 and 7. The person skilled in the art is able to join said sequences in a functional manner. Advantageously the transit peptide part is cleaved off from the protein part shown in table II, application no. 18, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 18, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 18, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 18, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 18, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 18, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.17] and [0030.3.0.17] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 18, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 18, columns 5 and 7 or a sequence encoding a protein, as depicted in table II, application no. 18, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 18, columns 5 and 7 or a sequence encoding a protein, as depicted in table II, application no. 18, columns 5 and 7 in such a manner that the viroid sequence transports a sequence transcribed from a sequence as depicted in table I, application no. 18, columns 5 and 7 or a sequence encoding a protein as depicted in table II, application no. 18, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 18, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 18, columns 5 and 7.

In a preferred embodiment of the invention the nucleic acid sequences as shown in table I, application no. 18, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 18, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.17] and [0032.0.0.17] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 18, column 3. Preferably the modification of the activity of a protein as shown in table II, application no. 18, column 3 or their combination can be achieved by joining the protein to a transit peptide.

Surprisingly it was found, that the transgenic expression of the *Saccaromyces cerevisiae* protein as shown in table II, application no. 18, column 3 in plastids of a plant such as *Arabidopsis thalaiana* for example through the linkage to at least one targeting sequence for example as mentioned in table V conferred an increase in the fine chemical content of the transformed plants.

for the disclosure of this paragraph see paragraph [0035.0.0.0] above.

The sequence of b1551 (Accession number PIR:B64910) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of Coenzyme Q9 and/or Coenzyme Q10, in particular for increasing the amount of Coenzyme Q9 in free or bound form in an organism or a part thereof, as mentioned. In one embodiment, in the process of the present invention the activity of a b1551 protein is increased or generated, e.g. from *Escherichia coli* or a homolog thereof, preferably linked at least to one transit peptide as mentioned for example in table V.

In another embodiment, in the process of the present invention the activity of a b1551 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of Coenzyme Q9 and/or Coenzyme Q10, in particular for increasing the amount of Coenzyme Q9 in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1704 (Accession number NP_416219) from *Escherichia coli* has been published in Blattner et al., Science 277 (5331), 1453-1474 (1997), and its activity is being defined as "3-deoxy-D-arabinoheptulosonate-7-phosphate synthase (DAHP synthetase), tryptophan-repressible". Accordingly, in one embodiment, the process of the present invention comprises the use of a "3-deoxy-D-arabinoheptulosonate-7phosphate synthase (DAHP synthetase), tryptophan-repressible" or its homolog, e.g. as shown herein, for the production of the fine chemical, meaning of Coenzyme Q9 and/or Coenzyme Q10, in particular for increasing the amount of Coenzyme Q9 and/or Coenzyme Q10 in free or bound form in an organism or a part thereof, as mentioned. In one embodiment, in the process of the present invention the activity of a b1704 protein is increased or generated, e.g. from *Escherichia coli* or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b2600 (Accession number NP_417091) from *Escherichia coli* has been published in Blattner et al., Science 277 (5331), 1453-1474 (1997), and its activity is being defined as "bifunctional chorismate mutase/prephenate dehydrogenase". Accordingly, in one embodiment, the process of the present invention comprises the use of a "bifunctional chorismate mutase/prephenate dehydrogenase" or its homolog, e.g. as shown herein, for the production of the fine chemical, meaning of Coenzyme Q9 and/or Coenzyme Q10, in particular for increasing the amount of Coenzyme Q9 and/or Coenzyme Q10 in free or bound form in an organism or a part thereof, as mentioned.

In one embodiment, in the process of the present invention the activity of a b2600 protein is increased or generated, e.g. from *Escherichia coli* or a homolog thereof, preferably linked at least to one transit peptide as mentioned for example in table V.

In another embodiment, in the process of the present invention the activity of a b2600 protein is increased or generated in a subcellular compartment of the organism or organism cell such as in an organelle like a plastid or mitochondria.

The sequence of b2965 (Accession number NP_417440) from *Escherichia coli* has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of Coenzyme Q9 and/or Coenzyme Q10, in particular for increasing the amount of Coenzyme Q9 in free or bound form in an organism or a part thereof, as mentioned. In one embodiment, in the process of the present invention the activity of a b2965 protein is increased or generated, e.g. from *Escherichia coli* or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b4039 (Accession number PIR:S25660) from *Escherichia coli* has been published in Blattner et al., Science 277 (5331), 1453-1474 (1997), and its activity is being defined as "4-hydroxybenzoate synthetase". Accordingly, in one embodiment, the process of the present invention comprises the use of a "4-hydroxybenzoate synthetase" or its homolog, e.g. as shown herein, for the production of the fine chemical, meaning of Coenzyme Q9 and/or Coenzyme Q10, in particular for increasing the amount of Coenzyme Q9 in free or bound form in an organism or a part thereof, as mentioned. In one embodiment, in the process of the present invention the activity of a b4039 protein is increased or generated, e.g. from *Escherichia coli* or a homolog thereof, preferably linked at least to one transit peptide as mentioned for example in table V.

In another embodiment, in the process of the present invention the activity of a b4039 protein is increased or generated in a subcellular compartment of the organism or organism cell such as in an organelle like a plastid or mitochondria.

In one embodiment, the homolog of the b1551, b1556, b1704, b1704, b2600, b2965 or b4039 is a homolog having said activity and being derived from bacteria. In one embodiment, the homolog of the b1551, b1556, b1704, b1704, b2600, b2965 or b4039 is a homolog having said activity and being derived from Proteobacteria. In one embodiment, the homolog of the b1551, b1556, b1704, b1704, b2600, b2965 or b4039 is a homolog having said activity and being derived from Gammaproteobacteria. In one embodiment, the homolog of the b1551, b1556, b1704, b1704, b2600, b2965 or b4039 is a homolog having said activity and being derived from Enterobacteriales. In one embodiment, the homolog of the b1551, b1556, b1704, b1704, b2600, b2965 or b4039 is a homolog having said activity and being derived from Enterobacteriaceae. In one embodiment, the homolog of the b1551, b1556, b1704, b1704, b2600, b2965 or b4039 is a homolog having said activity and being derived from *Escherichia*, preferably from *Escherichia coli*.

for the disclosure of this paragraph see paragraph [0038.0.0.0] above.

In accordance with the invention, a protein or polypeptide has the "activity of an protein as shown in table II, application no. 18, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 18, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 18, column 3, or which has at least 10% of the original enzymatic activity, preferably 20%, particularly preferably 30%, most particularly preferably 40% in comparison to a protein as shown in table II, application no. 18, column 3 of *Saccharomyces cerevisiae*.

for the disclosure of the paragraphs [0040.0.0.17] to [0047.0.0.17] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 18, column 3 its biochemical or genetical causes and the increased amount of the fine chemical.

for the disclosure of the paragraphs [0049.0.0.17] to [0051.0.0.17] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 18, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modifiy the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.17] to [0058.0.0.17] see paragraphs [0053.0.0.0] to [0058.0.0.0] above.

In case the activity of the *Escherichia coli* protein b1551 or its homologs, e.g. a "Qin prophage" is increased advantageously in an organelle such as a plastid or mitochondria, preferably, in one embodiment an increase of the fine chemical, preferably of Coenzyme Q9 in free or bound form between 50% and 84% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of Coenzyme Q9 in free or bound form between 53% and 98% or more is conferred. In case the activity of the *Escherichia coli* protein b1704 or its homologs, e.g. a "3deoxy-D-arabinoheptulosonate-7-phosphate synthase (DAHP synthetase), tryptophan-repressible" is increased advantageously in an organelle such as a plastid or mitochondria, preferably, in one embodiment an increase of the fine chemical, preferably of Coenzyme Q9 in free or bound form between 43% and 236% or more is conferred. In case the activity of the *Escherichia coli* protein b1704 or its homologs, e.g. a "3deoxy-D-arabinoheptulosonate-7-phosphate synthase (DAHP synthetase), tryptophan-repressible" is increased advantageously in an organelle such as a plastid or mitochondria, preferably, in one embodiment an increase of the fine chemical, preferably of Coenzyme Q10 in free or bound form between 28% and 369% or more is conferred.

In case the activity of the *Escherichia coli* protein b1704 or its homologs, e.g. a "3deoxy-D-arabinoheptulosonate-7-phosphate synthase (DAHP synthetase), tryptophan-repressible" is increased advantageously in an organelle such as a plastid or mitochondria, preferably, in one embodiment an increase of the fine chemical, preferably of Coenzyme Q10 in free or bound form between 28% and 369% or more and of coenzyme Q9 in free or bound form between 43% and 236% is conferred.

In case the activity of the *Escherichia coli* protein b2600 or its homologs, e.g. a "bifunctional chorismate mutase/ prephenate dehydrogenase" is increased advantageously in an organelle such as a plastid or mitochondria, preferably, in one embodiment an increase of the fine chemical, preferably of Coenzyme Q10 in free or bound form between 87% and 101% or more is conferred.

In case the activity of the *Escherichia coli* protein b2965 or its homologs, e.g. a "ornithine decarboxylase is increased advantageously in an organelle such as a plastid or mitochondria, preferably, in one embodiment an increase of the fine chemical, preferably of Coenzyme Q9 in free or bound form between 40% and 198% or more is conferred.

In case the activity of the *Escherichia coli* protein b4039 or its homologs, e.g. a "4hydroxybenzoate synthetase" is increased advantageously in an organelle such as a plastid or mitochondria, preferably, in one embodiment an increase of the fine chemical, preferably of Coenzyme Q9 in free or bound form between 53% and 113% or more is conferred.

In case the activity of the *Escherichia coli* proteins b1551, b1556, b1704, b1704, b2600, b2965 and/or b4039 or their homologs, are increased advantageously in an organelle such as a plastid or mitochondria, preferably an increase of the fine chemical such as Coenzyme Q9 or Coenzyme Q10 or mixtures thereof in free or bound forms conferred.

for the disclosure of the paragraphs [0061.0.0.17] and [0062.0.0.17] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 18, column 7 or of the polypeptide as shown in the amino acid sequences as disclosed in table II, application no. 18, columns 5 and 7 or the functional homologues thereof as described herein, or is encoded by the nucleic acid molecule characterized herein or the nucleic acid molecule according to the invention, for example by the nucleic acid molecule as shown in table I, application no. 18, columns 5 and 7 or its herein described functional homologues and has the herein mentioned activity.
/
for the disclosure of the paragraphs [0065.0.0.17] and [0066.0.0.17] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 18, columns 5 and 7 or its homologs activity having herein-mentioned Coenzyme Q9 and/or Coenzyme Q10 increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 18, columns 5 and 7, e.g. a nucleic acid sequence encoding a polypeptide having the activity of a protein as indicated in table II, application no. 18, columns 5 and 7 or its homologs activity or of a mRNA encoding the polypeptide of the present invention having herein-mentioned Coenzyme Q9 and/or Coenzyme Q10increasing activity; and/or c) increasing the specific activity of a protein conferring the increased expression of a protein encoded by the nucleic acid molecule of the invention or of the polypeptide of the present invention having herein-mentioned Coenzyme Q9 and/or Coenzyme Q10 increasing activity, e.g. of a polypeptide having the activity of a protein as indicated in table II, application no. 18, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned Coenzyme Q9 and/or Coenzyme Q10 increasing activity, e.g. of a polypeptide having the activity of a protein as indicated in table II, application no. 18, columns 5 and 7 or its homologs activity; and/or e) stimulating activity of a protein conferring the increased expression of a protein encoded by the nucleic acid molecule of the present invention or a polypeptide of the present invention having herein-mentioned Coenzyme Q9 and/or Coenzyme Q10 increasing activity, e.g. of a polypeptide having the activity of a protein as indicated in table II, application no. 18, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned Coenzyme Q9 and/or Coenzyme Q10 increasing activity, e.g. of a polypeptide having the activity of a protein as indicated in table II, application no. 18, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned Coenzyme Q9 and/or Coenzyme Q10 increasing activity, e.g. of a polypeptide having the activity of a protein as indicated in table II, application no. 18, columns 5 and 7 or its homologs activity; and/or h) increasing the expression of the endogenous gene encoding the polypeptide of the invention, e.g. a polypeptide having the activity of a protein as indicated in table II, application no. 18, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned Coenzyme Q9 and/or Coenzyme Q10 increasing activity, e.g. of polypeptide having the activity of a protein as indicated in table II, application no. 18, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned Coenzyme Q9 and/or Coenzyme Q10 increasing activity, e.g. of a polypeptide having the activity of a protein as indicated in table II, application no. 18, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned Coenzyme Q9 and/or Coenzyme Q10 increasing activity, e.g. of a polypeptide having the activity of a protein as indicated in table II, application no. 18, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 18, column 3 or its homologs. Preferably the increase of the fine chemical takes place in plastids.

for the disclosure of the paragraphs [0069.0.0.17] to [0079.0.0.17] see paragraphs [0069.0.0.0] to [0079.0.0.0] above.

The activation of an endogenous polypeptide having above-mentioned activity, e.g. having the activity of a protein as shown in table II, application no. 18, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 18, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 18, column 3. The expression of the chimeric transcription factor in a organism, in particular in a plant, leads to a specific expression of the protein as shown in table II, application no. 18, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.17] to [0084.0.0.17] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. Coenzyme Q9 and/or Coenzyme Q10 and mixtures thereof.

for the disclosure of this paragraph see paragraph [0086.0.0.0] above.

By influencing the metabolism thus, it is possible to produce, in the process according to the invention, further advantageous compounds. Examples of such compounds are, in addition to Coenzyme Q9 and/or Coenzyme Q10 compounds such as other Coenzymes such as Coenzyme Q0 to Q8, vitamins, amino acids or fatty acids.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 18, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound Coenzymes such as Coenzyme Q0 to Q8 or mixtures thereof.

The organism such as microorganisms or plants or the recovered, and if desired isolated, fine chemical can then be processed further directly into foodstuffs or animal feeds or for other applications, for example according to the disclosures made in the following US patent publications: U.S. Pat. No. 6,380,252: Use of L-acetylcarnitine, L-isovalerylcarnitine, L-propionylcarnitine for increasing the levels of IGF-1, U.S. Pat. No. 6,372,198: Dentifrice for the mineralization and remineralization of teeth, U.S. Pat. No. 6,368,617: Dietary supplement, U.S. Pat. No. 6,350,473: Method for treating hypercholesterolemia, hyperlipidemia, and atherosclerosis, U.S. Pat. No. 6,335,361: Method of treating benign forgetfulness, U.S. Pat. No. 6,329,432: Mesozeaxanthin formulations for treatment of retinal disorders, U.S. Pat. No. 6,328,987: Cosmetic skin care compositions containing alpha interferon, U.S. Pat. No. 6,312,703: Compressed lecithin preparations, U.S. Pat. No. 6,306,392: Composition comprising a carnitine and glutathione, useful to increase the absorption of glutathione and synergize its effects, U.S. Pat. No. 6,303,586: Supportive therapy for diabetes, hyperglycemia and hypoglycemia, U.S. Pat. No. 6,297,281: Association of no synthase inhibitors with trappers of oxygen reactive forms, U.S. Pat. No. 6,294,697: Discrete-length polyethylene glycols, U.S. Pat. No. 6,277,842: Dietary supplemental method for fat and weight reduction, U.S. Pat. No. 6,261,250: Method and apparatus for enhancing cardiovascular activity and health through rhythmic limb elevation, U.S. Pat. No. 6,258,855: Method of retarding and ameliorating carpal tunnel syndrome, U.S. Pat. No. 6,258,848: Methods and compositions for increasing insulin sensitivity, U.S. Pat. No. 6,258,847: Use of 2-mercaptoethanolamine (2-MEA) and related aminothiol compounds and copper(II)-3,5 di-isopropyl salicylates and related compounds in the prevention and treatment of various diseases, U.S. Pat. No. 6,255,354: Preparation of a pulmonary surfactant for instillation and oral application, U.S. Pat. No. 6,254,547: Breath methylated alkane contour: a new marker of oxidative stress and disease, U.S. Pat. No. 6,248,552: Enzyme-based assay for determining effects of exogenous and endogenous factors on cellular energy production, U.S. Pat. No. 6,248,363: Solid carriers for improved delivery of active ingredients in pharmaceutical compositions, U.S. Pat. No. 6,245,800: Method of preventing or treating statin-induced toxic effects using L-carnitine or an alkanoyl L-carnitine, U.S. Pat. No. 6,245,378: Nutritional supplement for facilitating skeletal muscle adaptation to strenuous exercise and counteracting defatigation in asthenic individuals, U.S. Pat. No. 6,242,491: Use of creatine or creatine compounds for skin preservation, U.S. Pat. No. 6,232,346: Composition for improvement of cellular nutrition and mitochondrial energetics, U.S. Pat. No. 6,231,836: Folic acid dentifrice, U.S. Pat. No. 6,228,891: Use of 2,3-dimethoxy-5-methyl-6decaprenyl-1,4-benzoquinone, U.S. Pat. No. 6,228,402: Xylitol-containing non-human foodstuff and method, U.S. Pat. No. 6,228,347: Antioxidant gel for gingival conditions, U.S. Pat. No. 6,218,436: Pharmaceutically active carotenoids, U.S. Pat. No. 6,203,818: Nutritional supplement for cardiovascular health, U.S. Pat. No. 6,200,550: Oral care compositions comprising coenzyme Q10, U.S. Pat. No. 6,191,172: Water-soluble compositions of bioactive lipophilic compounds, U.S. Pat. No. 6,184,255: Pharmaceutical composition comprising coenzyme Q10, U.S. Pat. No. 6,166,077: Use of L-acetylcarnitine, L-isovalerylcarnitine, L-propionylcarnitine for increasing the levels of IGF-1, U.S. Pat. No. 6,162,419: Stabilized ascorbyl compositions, U.S. Pat. No. 6,159,508: Xylitol-containing non-human foodstuff and method, U.S. Pat. No. 6,159,476: Herbal supplement for increased muscle strength and endurance for athletes, U.S. Pat. No. 6,153,582: Defined serum-free medical solution for ophthalmology, U.S. Pat. No. 6,136,859: Pharmaceutical formulation for treating liver disorders, U.S. Pat. No. 6,107,281: Compounds and their combinations for the treatment of influenza infection, U.S. Pat. No. 6,106,286: Method and device for administering medicine to the periodontium, U.S. Pat. No. 6,099,854: Dry composition containing flavonol useful as a food supplement, U.S. Pat. No. 6,086,910: Food supplements, U.S. Pat. No. 6,080,788: Composition for improvement of cellular nutrition and mitochondrial energetics, U.S. Pat. No. 6,069,167: Use of antioxidant agents to treat cholestatic liver disease, U.S. Pat. No. 6,063,820: Medical food for diabetics, U.S. Pat. No. 6,054,261: Coenzyme Q.sub.10 compositions for organ protection during perfusion, U.S. Pat. No. 6,051,250: Process for the stabilization of vesicles of amphiphilic lipid(s) and composition for topical application containing the said stabilized vesicles, The fermentation broth, fermentation products, plants or plant products can be purified in the customary manner by hydrolysis with strong bases, extraction and crystallization or via thin layer chromatography and other methods known to the person skilled in the art and described herein below. Products of these different work-up procedures are fatty acids or fatty acid compositions which still comprise fermentation broth, plant particles and cell components in different amounts, advantageously in the range of from 0 to 99% by weight, preferably below 80% by weight, especially preferably between below 50% by weight.

Coenzyme Q10 production was reported in *Agrobacterium* sp., Protaminobacter rubber and *Paracoccus denitrificans*. Coenzyme Q9 production was reported in *Candida tropicalis*. Production of ubiquiones with side chain length of 6-10 units, e.g. including Coenzyme Q10 and Coenzyme Q9 was reported for controlled continuous culture of phototrophic bacteria (wild-type strains of *Rhodobacter capsulatus, Rhodobacter sphaeroides, Thiocapsa roseopersicina* and *Ectothiorhodospira shaposhnikovii*. Cells mostly contained one main ubiquinone, whereby the content and composition dependent on growth conditions, substrates and other factors. Preferred is a production of more than 0.1, preferably more than 1 to 6 mg/g dry cells in one of said organisms or in any other microorganism, even more preferred are more than 10 mg/g dry cells, 20 mg/g dry cells, 50 mg/g dry cells, 100 mg/g dry cells, 200 mg/g dry cells, 300 mg/g dry cells, 500 mg/g dry cells or more.

for the disclosure of the paragraphs [0090.0.0.17] to [0097.0.0.17] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 18, columns 5 and 7 or a derivative thereof, or
b) a genetic regulatory element, for example a promoter, which is functionally linked to the nucleic acid sequence as shown table I, application no. 18, columns 5 and 7 or a derivative thereof, or
c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 18, columns 5 and 7 joined to a nucleic acid sequence encoding a transit peptide, or a targeting nucleic acid sequence which directs the nucleic acid sequences disclosed in table I, application no. 18, columns 5 and 7 to the organelle preferentially the plastids. Altenatively the inventive nucleic acids sequences consist advantageously of the nucleic acid sequences as depicted in the sequence protocol and disclosed in table I, application no. 18, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose Coenzyme Q9 and/or Coenzyme Q10 content is modified advantageously owing to the nucleic acid molecule of the present invention expressed. This is important for plant breeders since, for example, the nutritional value of plants for animals is dependent on the abovementioned Coenzyme Q9 and/or Coenzyme Q10 and the general amount of Coenzyme Q9 and/or Coenzyme Q10 in feed. After the activity of the protein as shown in table II, application no. 18, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.17] to [0110.0.0.17] see paragraphs [0102.0.0.0] to [0110.0.0.0] above.

In a preferred embodiment, the fine chemical (Coenzyme Q9 and/or Coenzyme Q10) is produced in accordance with the invention and, if desired, is isolated. The production of further Coenzymes such as Coenzyme Q0 to Q8 and mixtures thereof or mixtures of other Coenzymes by the process according to the invention is advantageous. It may be advantageous to increase the pool of free Coenzymes such as Coenzyme Q9 and/or Coenzyme Q10 and others as aforementioned in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example another gene of the Coenzyme Q9 and/or Coenzyme Q10 biosynthesis, or a compound, which functions as a sink for the desired Coenzyme Q9 and/or Coenzyme Q10 in the organism is useful to increase the production of the respective fine chemical.

In a preferred embodiment, the respective fine chemical is produced in accordance with the invention and, if desired, is isolated. The production of further Coenzymes other then Coenzyme Q9 and/or Coenzyme Q10 or compounds for which the respective fine chemical is a biosynthesis precursor compounds, e.g. amino acids, or mixtures thereof or mixtures of other Coenzymes, in particular of Coenzyme Q0 to Q8, by the process according to the invention is advantageous. Preferably the composition further comprises higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including amino acids, fatty acids, vitamins, coenzymes, antioxidants etc. or any one of their precursors, required for the cell's biosynthesis of the respective fine chemical may be increased so that the concentration of necessary or relevant precursors, e.g. of isoprenoids, acetyl CoA, HMGCoA, mevalonate, Isopentenyl pyrophosphate, Geranyl pyrophosphate, Farnesyl Pyrophosphate, or other cofactors or intermediates within the organelle, e.g. in mitochondria or plastids, resp., within (a) cell(s) or within the corresponding storage compartments is increased. Owing to the increased or novel generated activity of the polypeptide of the invention or used in the method of the invention or owing to the increased number of nucleic acid sequences of the invention or used in the method of the invention and/or to the modulation of further genes which are involved in the biosynthesis of the respective fine chemical, e.g. by increasing the activity of enzymes synthesizing precursors, e.g. Lovastatin, HMG-CoA Reductase, Mevalonate Kinase, or by destroying the activity of one or more genes which are involved in the breakdown of the respective fine chemical, it is possible to increase the yield, production and/or production efficiency of the respective fine chemical in the host organism, such as plants or the microorganisms.

In the case of the fermentation of microorganisms, the abovementioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fine chemical such as Coenzyme Q9 and/or Coenzyme Q10 synthesized in the process according to the invention can advantageously be marketed directly without there being any need for the fine chemical synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

However, the respective fine chemical produced in the process according to the invention can also be isolated from the organisms, advantageously plants, (in the form of their organic extracts, e.g. alcohol, or other organic solvents or water containing extract and/or free Coenzyme Q9 and/or Coenzyme Q10 or other extracts. The respective fine chemical produced by this process can be obtained by harvesting the organisms, either from the medium in which they grow, or from the field. This can be done via pressing or extraction of the plant parts. To increase the efficiency of extraction it is beneficial to clean, to temper and if necessary to hull and to flake the plant material. To allow for greater ease of disruption of the plant parts, specifically the seeds, they can previously be comminuted, steamed or roasted. Seeds, which have been pretreated in this manner can subsequently be pressed or extracted with solvents such as organic solvents like warm hexane or water or mixtures of organic solvents. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid.

Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose. However, it can be advantageous to avoid this treatment as it can result in cells devoid of most carotenoids.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 1127-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Coenzymes can for example be detected advantageously via LC separation methods. The unambiguous detection for the presence of Coenzymes products can be obtained by analyzing recombinant organisms using analytical standard methods like LC-MS, LC-MSMS, or TLC. The material to be analyzed can be disrupted by sonication, grinding in a glass mill, liquid nitrogen and grinding, cooking, or via other applicable methods; see also Biotechnology of Vitamins, Pigments and Growth Factors, edited by Erik J. Vandamme, London, 1989, p. 96 to 103.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 18, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 18, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table IIII, application no. 18, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 18, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 18, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 18, columns 5 and 7 by one or more nucleotides. In one embodiment, the nucleic acid molecule used in the process of the invention does not consist of the sequence indicated in table IA, application no. 18, columns 5 and 7. In one embodiment, the nucleic acid molecule used in the process of the invention is less than 100%, 99.999%, 99.99%, 99.9% or 99% identical to a sequence indicated in table IA, application no. 18, columns 5 and 7. In another embodiment, the nucleic acid molecule does not encode a polypeptide of a sequence indicated in table IIA, application no. 18, columns 5 and 7.

In one embodiment, the nucleic acid molecule used in the process of the invention distinguishes over the sequence indicated in table IB, application no. 18, columns 5 and 7, by one or more nucleotides. In one embodiment, the nucleic acid molecule used in the process of the invention does not consist of the sequence indicated in table IB, application no. 18, columns 5 and 7. In one embodiment, the nucleic acid molecule used in the process of the invention is less than 100%, 99.999%, 99.99%, 99.9% or 99% identical to a sequence indicated in table IB, application no. 18, columns 5 and 7. In another embodiment, the nucleic acid molecule does not encode a polypeptide of a sequence indicated in table IIB, application no. 18, columns 5 and 7.

In one embodiment, the nucleic acid molecule used in the process distinguishes over the sequence shown in table I, application no. 18, columns 5 and 7 by one or more nucleotides or does not consist of the sequence shown in table I, application no. 18, columns 5 and 7. In one embodiment, the nucleic acid molecule of the present invention is less than 100%, 99.999%, 99.99%, 99.9% or 99% identical to the sequence shown in table I, application no. 18, columns 5 and 7. In another embodiment, the nucleic acid molecule does not encode a polypeptide of the sequence shown in table II, application no. 18, columns 5 and 7.

for the disclosure of the paragraphs [0118.0.0.17] to [0120.0.0.17] see paragraphs [0118.0.0.0] to [0120.0.0.0] above.

Nucleic acid molecules with the sequence shown in table I, application no. 18, columns 5 and 7, nucleic acid molecules which are derived from the amino acid sequences shown in table II, application no. 18, columns 5 and 7 or from polypeptides comprising the consensus sequence shown in table IV, application no. 18, column 7, or their derivatives or homologues encoding polypeptides with the enzymatic or biological activity of a protein as shown in table II, application no. 18, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 18, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 18, column 3 and conferring the fine chemical increase by expression either in the cytsol or in an organelle such as a plastid or mitochondria or both, preferably in plastids.

for the disclosure of the paragraphs [0126.0.0.17] to [0133.0.0.17] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 18, columns 5 and 7 or the functional homologues thereof as described herein, preferably conferring above-mentioned activity, i.e. conferring the fine chemical increase after increasing its activity, e.g. after increasing the activity of a protein as shown in table II, application no. 18, column 3 by for example expression either in the cytsol or in an organelle such as a plastid or mitochondria or both, preferably in plastids.

for the disclosure of the paragraphs [0135.0.0.17] to [0140.0.0.17] see paragraphs [0135.0.0.0] to [0140.0.0.0] above.

Synthetic oligonucleotide primers for the amplification, e.g. as shown in table III, application no. 18, column 7, by means of polymerase chain reaction can be generated on the basis of a sequence shown herein, for example the sequence shown in table I, application no. 18, columns 5 and 7 or the sequences derived from table II, application no. 18, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 18, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 18, column 3 or further functional homologs of the polypeptide of the invention from other organisms.

for the disclosure of the paragraphs [0144.0.0.17] to [0151.0.0.17] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 18, columns 5 and 7, preferably of table IB, application no. 18, columns 5 and 7 under relaxed hybridization conditions and which code on expression for peptides having the Coenzyme Q9 and/or Coenzyme Q10 increasing activity.

for the disclosure of the paragraphs [0153.0.0.17] to [0159.0.0.17] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 18, columns 5 and 7, preferably shown in table IB, application no. 18, columns 5 and 7 is one which is sufficiently complementary to one of the nucleotide sequences shown in table I, application no. 18, columns 5 and 7, preferably shown in table IB, application no. 18, columns 5 and 7 such that it can hybridize to one of the nucleotide sequences shown in table I, application no. 18, columns 5 and 7, preferably shown in table IB, application no. 18, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 18, columns 5 and 7, preferably shown in table IB, application no. 18, columns 5 and 7, or a portion thereof and preferably has above mentioned activity, in particular having a fine chemical increasing activity after increasing the activity or an activity of a gene product as shown in table II, application no. 18, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 18, columns 5 and 7, preferably shown in table IB, application no. 18, columns 5 and 7, or a portion thereof and encodes a protein having above-mentioned activity, e.g. conferring of a Coenzyme Q9 and/or Coenzyme Q10 increase by for example expression either in the cytsol or in an organelle such as a plastid or mitochondria or both, preferably in plastids, and optionally, the activity of a protein as shown in table II, application no. 18, column 3.

Moreover, the nucleic acid molecule of the invention can comprise only a portion of the coding region of one of the sequences shown in table I, application no. 18, columns 5 and 7, preferably shown in table IB, application no. 18, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 18, columns 5 and 7, an anti-sense sequence of one of the sequences, e.g., set forth in table I, application no. 18, columns 5 and 7, preferably shown in table IB, application no. 18, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 18, column 7 will result in a fragment of the gene product as shown in table II, column 3.

for the disclosure of this paragraph see paragraph [0164.0.0.0] above.

[0165.0.17.171 The nucleic acid molecule of the invention encodes a polypeptide or portion thereof which includes an amino acid sequence which is sufficiently homologous to the amino acid sequence shown in table II, application no. 18, columns 5 and 7 such that the protein or portion thereof maintains the ability to participate in the fine chemical production, in particular a Coenzyme Q9 and/or Coenzyme Q10 increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 18, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 18, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.17] and [0169.0.0.17] see paragraphs [0168.0.0.0] and [0169.0.0.0] above.

The invention further relates to nucleic acid molecules that differ from one of the nucleotide sequences shown in table I, application no. 18, columns 5 and 7 (and portions thereof due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 18, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 18, columns 5 and 7 or the functional homologues. In a still further embodiment, the nucleic acid molecule of the invention encodes a full length protein which is substantially homologous to an amino acid sequence shown in table II, application no. 18, columns 5 and 7 or the functional homologues. However, in a preferred embodiment, the nucleic acid molecule of the present invention does not consist of the sequence shown in table I, application no. 18, columns 5 and 7, preferably as indicated in table IA, application no. 18, columns 5 and 7. Preferably the nucleic acid molecule of the invention is a functional homologue or identical to a nucleic acid molecule indicated in table IB, application no. 18, columns 5 and 7.

for the disclosure of the paragraphs [0171.0.0.17] to [0173.0.0.17] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 18, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 18, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 18, columns 5 and 7.

for the disclosure of the paragraphs [0179.0.0.17] and [0180.0.0.17] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 18, columns 5 and 7, preferably shown in table IIA, application no. 18, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 18, columns 5 and 7, preferably shown in table IIA, application no. 18, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 18, columns 5 and 7, preferably shown in table II A, application no. 18, columns 5 and 7, more preferably at least about 70% identical to one of the sequences shown in table II, application no. 18, columns 5 and 7, preferably shown in table IIA, application no. 18, columns 5 and 7, even more preferably at least about 80%, 90%, 95% homologous to the sequence shown in table II, application no. 18, columns 5 and 7, preferably shown in table IIA, application no. 18, columns 5 and 7, and most preferably at least about 96%, 97%, 98%, or 99% identical to the sequence shown in table II, application no. 18, columns 5 and 7, preferably shown in table IIA, application no. 18, columns 5 and 7.

for the disclosure of the paragraphs [0182.0.0.17] to [0188.0.0.17] see paragraphs [0182.0.0.0] to [0188.0.0.0] above.

Functional equivalents derived from one of the polypeptides as shown in table II, application no. 18, columns 5 and 7, preferably shown in table IIB, application no. 18, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 18, columns 5 and 7, preferably shown in table IIB, application no. 18, columns 5 and 7 resp., according to the invention and are distinguished by essentially the same properties as the polypeptide as shown in table II, application no. 18, columns 5 and 7, preferably shown in table IIB, application no. 18, columns 5 and 7.

Functional equivalents derived from the nucleic acid sequence as shown in table I, application no. 18, columns 5 and 7, preferably shown in table IB, application no. 18, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 18, columns 5 and 7, preferably shown in table IIB, application no. 18, columns 5 and 7 resp., according to the invention and encode polypeptides having essentially the same properties as the polypeptide as shown in table II, application no. 18, columns 5 and 7, preferably shown in table IIB, application no. 18, columns 5 and 7.

for the disclosure of this paragraph see paragraph [0191.0.0.0] above.

A nucleic acid molecule encoding an homologous to a protein sequence of table II, application no. 18, columns 5 and 7, preferably shown in table IIB, application no. 18, columns 5 and 7 resp., can be created by introducing one or more nucleotide substitutions, additions or deletions into a nucleotide sequence of the nucleic acid molecule of the present invention, in particular of table I, application no. 18, columns 5 and 7, preferably shown in table IB, application no. 18, columns 5 and 7 resp., such that one or more amino acid substitutions, additions or deletions are introduced into the encoded protein. Mutations can be introduced into the encoding sequences of table I, application no. 18, columns 5 and 7, preferably shown in table IB, application no. 18, columns 5 and 7 resp., by standard techniques, such as site-directed mutagenesis and PCR-mediated mutagenesis.

for the disclosure of the paragraphs [0193.0.0.17] to [0196.0.0.17] see paragraphs [0193.0.0.0] to [0196.0.0.0] above.

Homologues of the nucleic acid sequences used, with the sequence shown in table I, application no. 18, columns 5 and 7, preferably shown in table IB, application no. 18, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 18, columns 5 and 7, preferably shown in table IB, application no. 18, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 18, columns 5 and 7, preferably shown in table IB, application no. 18, columns 5 and 7. It is preferred that the nucleic acid molecule comprises as little as possible other nucleotides not shown in any one of table I, application no. 18, columns 5 and 7, preferably shown in table IB, application no. 18, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 18, columns 5 and 7, preferably shown in table IB, application no. 18, columns 5 and 7.

Also preferred is that the nucleic acid molecule used in the process of the invention encodes a polypeptide comprising the sequence shown in table II, application no. 18, columns 5 and 7, preferably shown in table IIB, application no. 18, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 18, columns 5 and 7, preferably shown in table IIB, application no. 18, columns 5 and 7.

In one embodiment, the nucleic acid molecule of the invention or used in the process encodes a polypeptide comprising the sequence shown in table II, application no. 18, columns 5 and 7, preferably shown in table IIB, application no. 18, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 18, columns 5 and 7, preferably shown in table IB, application no. 18, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 18, columns 5 and 7 expressed under identical conditions.

Homologues of table I, application no. 18, columns 5 and 7 or of the derived sequences of table II, application no. 18, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.17] to [0215.0.0.17] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 18, columns 5 and 7, preferably in table IIB, application no. 18, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 18, columns 5 and 7, preferably in table IB, application no. 18, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 18, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 18, column 7 and conferring an increase in the amount of the fine chemical in an organism or a part thereof;

k) nucleic acid molecule encoding the amino acid sequence of a polypeptide encoding a domain of the polypeptide shown in table II, application no. 18, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 18, columns 5 and 7 or a nucleic acid molecule encoding, preferably at least the mature form of, the polypeptide shown in table II, application no. 18, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table I A and/or I B, application no. 18, columns 5 and 7 by one or more nucleotides. In one embodiment, the nucleic acid molecule of the invention does not consist of the sequence shown in table I A and/or I B, application no. 18, columns 5 and 7. In another embodiment, the nucleic acid molecule of the present invention is at least 30% identical and less than 100%, 99.999%, 99.99%, 99.9% or 99% identical to the sequence shown in table I A and/or I B, application no. 18, columns 5 and 7. In a further embodiment the nucleic acid molecule does not encode the polypeptide sequence shown in table II A and/or II B, application no. 18, columns 5 and 7. Accordingly, in one embodiment, the nucleic acid molecule of the present invention encodes in one embodiment a polypeptide which differs at least in one or more amino acids from the polypeptide shown in table II A and/or II B, application no. 18, columns 5 and 7 does not encode a protein of the sequence shown in table II A and/or II B, application no. 18, columns 5 and 7. Accordingly, in one embodiment, the protein encoded by a sequence of a nucleic acid according to (a) to (l) does not consist of the sequence shown in table I A and/or I B, application no. 18, columns 5 and 7. In a further embodiment, the protein of the present invention is at least 30% identical to protein sequence depicted in table II A and/or II B, application no. 18, columns 5 and 7 and less than 100%, preferably less than 99.999%, 99.99% or 99.9%, more preferably less than 99%, 985, 97%, 96% or 95% identical to the sequence shown in table II A and/or II B, application no. 18, columns 5 and 7.

for the disclosure of the paragraphs [0217.0.0.17] to [0226.0.0.17] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transit peptide and that the nucleic acids of the invention, preferentially the nucleic acid sequences encoding the polypeptides shown in table II, application no. 18, columns 5 and 7 can be cloned 3' prime to the transit peptide encoding sequence, leading to a functional preprotein, which is directed to the plastids and which means that the mature protein fulfills its biological activity.

for the disclosure of the paragraphs [0228.0.0.17] to [0239.0.0.17] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 18, columns 5 and 7 or its derivatives, it is advantageous additionally to express and/or mutate further genes in the organisms. Especially advantageously, additionally at least one further gene of the Coenzyme Q9 and/or Coenzyme Q10 biosynthetic pathway is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 18, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the Coenzyme Q metabolism, in particular in synthesis of Coenzyme Q9 and/or Coenzyme Q10. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the abovementioned biosynthesis genes are the sequences encoding further genes of the isoprenoid biosynthetic pathway such as genes for acetyl CoA, HMG-CoA, Mevalonate, Isopentyl pyrophosphate, Geranyl pyrophosphate, Farnesyl pyrophosphate e.g. HMG-CoA Reductase, Mevalonate, Kinase, etc. It is also possible that the regulation of the natural genes has been modified advantageously so that the gene and/or its gene product is no longer subject to the regulatory mechanisms which exist in the organisms. This leads to an increased synthesis of the isoprenoids, coenzyme precursor or coenzymes, preferably Q9 and/or Q10, as desired since, for example, feedback regulations no longer exist to the same extent or not at all.

In a further advantageous embodiment of the process of the invention, the organisms used in the process are those in which advantageously simultaneously a Coenzyme Q9 and/or Coenzyme Q10 degrading protein is attenuated, in particular by reducing the rate of expression of the corresponding gene, or by inactivating the gene for example the mutagenesis and/or selection. In another advantageous embodiment the synthesis of competitive pathways which rely on the same precursors are down regulated or interrupted.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemcical and other Coenzymes produced by this process can be obtained by harvesting the organisms, either from the crop in which they grow, or from the field. This can be done via for example pressing or extraction of the plant parts.

Preferably, the compound is a composition comprising the essentially pure Coenzyme Q9 and/or Coenzyme Q10 or a recovered or isolated Coenzyme Q9 and/or Coenzyme Q10.

for the disclosure of the paragraphs [0243.0.0.17] to [0264.0.0.17] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 18, columns 5 and 7 and described herein to achieve an expression in one of said compartments or extracellular.

for the disclosure of the paragraphs [0266.0.0.17] to [0287.0.0.17] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 18, columns 5 and 7 or their homologs is functionally linked to a plastidial targeting sequence. A further preferred embodiment of the invention relates to a vector in which a nucleic acid sequence encoding one of the polypeptides shown in table II, application no. 18, columns 5 and 7 or their homologs is functionally linked to a regulatory sequences which permit the expression in plastids.

for the disclosure of the paragraphs [0289.0.0.17] to [0296.0.0.17] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b1551, anti-b1556, anti-b1704, anti-b2600, anti-b2965 and/or anti-b4039 protein antibody or an antibody against polypeptides as shown in table II, application no. 18, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 18, columns 5 and 7 or as coded by the nucleic acid molecule shown in table I, application no. 18, columns 5 and 7 or functional homologues thereof.

In one advantageous embodiment, in the method of the present invention the activity of a polypeptide is increased comprising or consisting of the consensus sequence shown in table IV, application no. 18, columns 7 and in one another embodiment, the present invention relates to a polypeptide comprising or consisting of the consensus sequence shown in table IV, application no. 18, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.17] to [0304.0.0.17] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 18, columns 5 and 7 by one or more amino acids. In one embodiment, polypeptide distinguishes form the sequence shown in table IIA and/or IIB, application no. 18, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 18, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 18, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 18, columns 5 and 7 by one or more amino acids. In another embodiment, said polypeptide of the invention does not consist of the sequence shown in table IIA and/or IIB, application no. 18, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 18, columns 5 and 7.

In one embodiment, the present invention relates to a polypeptide having the activity of the protein as shown in table IIA and/or IIB, application no. 18, column 3, which distinguishes over the sequence depicted in table IIA and/or IIB, application no. 18, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.17] to [0311.0.0.17] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 18, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 18, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 18, columns 5 and 7 or which is homologous thereto, as defined above.

Accordingly the polypeptide of the present invention can vary from the sequences shown in table IIA and/or IIB, application no. 18, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 18, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 18, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 18, column 3. Differences shall mean at least one amino acid different from the sequences as shown in table II, application no. 18, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 18, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 18, column 3. The nucleic acid molecules and polypeptide molecules of the invention are expressed such that the yield, production, and/or efficiency of production of a desired compound is improved.

for the disclosure of the paragraphs [0320.0.0.17] to [0322.0.0.17] see paragraphs [0320.0.0.0] to [0322.0.0.0] above.

In one embodiment, a protein (=polypeptide) as shown in table II, application no. 18, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 18, column 3, e.g., a protein which does not confer the activity described herein and which is derived from the same or a different organism.

for the disclosure of the paragraphs [0324.0.0.17] to [0329.0.0.17] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 18, columns 5 and 7.

for the disclosure of the paragraphs [0331.0.0.17] to [0346.0.0.17] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 18, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 18, column 3 or a protein as shown in table II, application no. 18, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 18, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.17] to [0358.0.0.17] see paragraphs [0350.0.0.0] to [0358.0.0.0] above.

Transgenic plants comprising Coenzyme Q9, Coenzyme Q1 or mixtures thereof synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The Coenzyme Q9 and/or Coenzyme Q10 produced in the process according to the invention may, however, also be isolated from the plant in the form of their free Coenzyme Q9 and/or Coenzyme Q10 produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, cosmetics, pharmaceuticals or fine chemicals.

for the disclosure of the paragraphs [0360.0.0.17] to [0362.0.0.17] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the Coenzyme Q9 and/or Coenzyme Q10 produced in the process can be isolated. The resulting fine chemical can, if appropriate, subsequently be further purified, if desired mixed with other active ingredients such as other xanthophylls, fatty acids, vitamins, amino acids, carbohydrates, antibiotics and the like, and, if appropriate, formulated.

In one embodiment, Coenzyme Q9 and/or Coenzyme Q10 is the fine chemical.

The Coenzyme Q9 and/or Coenzyme Q10, in particular the respective fine chemicals obtained in the process are suitable as starting material for the synthesis of further products of value. For example, they can be used in combination with each other or alone for the production of pharmaceuticals, health products, foodstuffs, animal feeds, nutrients or cosmetics. Accordingly, the present invention relates a method for the production of pharmaceuticals, health products, food stuff, animal feeds, nutrients or cosmetics comprising the steps of the process according to the invention, including the isolation of the Coenzyme Q9 and/or Coenzyme Q10 containing, in particular Coenzyme Q9 and/or Coenzyme Q10 containing composition produced or the respective fine chemical produced if desired and formulating the product with a pharmaceutical acceptable carrier or formulating the product in a form acceptable for an application in agriculture. A further embodiment according to the invention is the use of the Coenzyme Q9 and/or Coenzyme Q10 produced in the process or of the transgenic organisms in animal feeds, foodstuffs, medicines, food supplements, cosmetics or pharmaceuticals.

for the disclosure of the paragraphs [0366.0.0.17] to [0369.0.0.17] see paragraphs [0366.0.0.0] to [0369.0.0.0] above.

The fermentation broths obtained in this way, containing in particular Coenzyme Q9 and/or Coenzyme Q10 in mixtures with other organic acids, amino acids, polypeptides or polysaccharides, normally have a dry matter content of from 1 to 70% by weight, preferably 7.5 to 25% by weight. Sugar-limited fermentation is additionally advantageous, e.g. at the end, for example over at least 30% of the fermentation time.

This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the Coenzyme Q9 and/or Coenzyme Q10, in particular the Coenzyme Q9 and/or Coenzyme Q10 produced according to the invention further. For this purpose, the product-containing composition, e.g. a total or partial extraction fraction using organic solvents, is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.17] to [0376.0.0.17], [0376.1.0.17] and [0377.0.0.17] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting-, e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 18, columns 5 and 7, preferably in table IB, application no. 18, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical; (d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.17] to [0383.0.0.17] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 18, column 3, e.g. comparing near identical organisms with low and high activity of the proteins as shown in table II, application no. 18, column 3.

for the disclosure of the paragraphs [0385.0.0.17] to [0404.0.0.17] see paragraphs [0385.0.0.0] to [0404.0.0.0] above.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other Coenzymes, in particular Coenzymes such as Coenzyme Q0 to Q8.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the fine chemical in an organism or part thereof, e.g. in a cell.

for the disclosure of the paragraphs [0406.0.0.17] to [0435.0.0.17] see paragraphs [0406.0.0.0] to [0435.0.0.0] above.

Production of Coenzyme Q9 and/or Coenzyme Q10 in *Chlamydomonas reinhardtii*

The Coenzyme Q9 and/or Coenzyme Q10 production can be analysed as mentioned herein.

The proteins and nucleic acids can be analysed as mentioned below.

In addition a production in other organisms such as plants or microorganisms such as yeast, *Mortierella* or *Escherichia coli* is possible.

for the disclosure of the paragraphs [0437.0.0.17] and [0438.0.0.17] see paragraphs [0437.0.0.0] and [0438.0.0.0] above.

Example 9

Analysis of the Effect of the Nucleic Acid Molecule on the Production of Coenzyme Q9 and/or Coenzyme Q10

The effect of the genetic modification of plants or algae on the production of a desired compound (such as Coenzyme Q9 and/or Coenzyme Q10) can be determined by growing the modified plant under suitable conditions (such as those described above) and analyzing the medium and/or the cellular components for the elevated production of desired product (i.e. of Coenzyme Q9 and/or Coenzyme Q10). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter II, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of and determination of the Coenzyme Q9 and/or Coenzyme Q10 content:

Abbreviations: GC-MS, gas liquid chromatography/mass spectrometry; TLC, thin-layer chromatography.

The unambiguous detection for the presence of xanthophylls can be obtained by analyzing recombinant organisms using analytical standard methods: LC, LC-MSMS or TLC, as described The total Coenzyme Q9 and/or Coenzyme Q10 produced in the organism for example in algae used in the inventive process can be analysed for example according to the following procedure:

The material such as algae or plants to be analyzed can be disrupted by sonication, grinding in a glass mill, liquid nitrogen and grinding or via other applicable methods. Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, separation of non-polar epiphase from more polar hypophasic derivatives and chromatography. E.g.:

For analysis, solvent delivery and aliquot removal can be accomplished with a robotic system comprising a single injector valve Gilson 232XL and a 4022S1V diluter [Gilson, Inc. USA, 3000 W. Beltline Highway, Middleton, Wis.]. For saponification, 3 ml of 50% potassium hydroxide hydro-ethanolic solution (4 water: 1 ethanol) can be added to each vial, followed by the addition of 3 ml of octanol. The saponification treatment can be conducted at room temperature with vials maintained on an IKA HS 501 horizontal shaker [Labworld-online, Inc., Wilmington, N.C.] for fifteen hours at 250 movements/minute, followed by a stationary phase of approximately one hour.

Following saponification, the supernatant can be diluted with 0.10 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol: 4 water: 15 tetrahydrofuran (THF) stabilized with 0.2% BHT (2,6-di-tert-butyl-4-methylphenol). Injections were 20 µl. Separation can be isocratic at 30° C. with a flow rate of 1.7 ml/minute. The peak responses can be measured by absorbance at 447 nm.

One example is the analysis of the coenzymes. The unambiguous detection for the presence of the coenzymes products can be obtained by analyzing recombinant organisms using analytical standard methods, especially HPLC with UV or electrochemical detection as for example described in The Journal of Lipid Research, Vol. 39, 2099-2105, 1998.

Possible methods for the production and preparation of coenzymes like Coenzyme Q10 has also been described for example in WO2003056024, J57129695, J57202294, DE3416853 and DD-229152. Further methods for the isolation of the respective fine chemical can also been found in WO 9500634, Fat-Sci. Technol.; (1992) 94, 4, 153-57, DD-294280, DD-293048, JP-145413, DD-273002, DD-271128, SU1406163, JP166837, JP-176705, Acta-Biotechnol.; (1986) 6, 3, 277-79, DD-229152, DE3416854, DE3416853, JP-202840, JP-048433, JP-125306, JP-087137, JP-014026, WO2003056024 and WO200240682.

Plant material is initially homogenized mechanically by comminuting in a pestle and mortar to make it more amenable to extraction.

for the disclosure of the paragraphs [0446.0.0.17] to [0496.0.0.17] see paragraphs [0446.0.0.0] to [0496.0.0.0] above.

Usually acetone or hexane is used for the extraction of the Coenzymes and further purification is achieved by column chromatography with a suitable resin.

If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

The results of the different plant analyses can be seen from the table, which follows:

TABLE VI

| ORF | Metabolite | Method | Min | Max |
| --- | --- | --- | --- | --- |
| b1551 | Coenzyme Q9 | LC | 1.50 | 1.84 |
| b1556 | Coenzyme Q9 | LC | 1.53 | 1.98 |
| b1704 | Coenzyme Q9 | LC | 1.43 | 3.36 |
| b1704 | Coenzyme Q10 | LC | 1.28 | 4.69 |
| b2600 | Coenzyme Q10 | LC | 1.87 | 2.01 |
| b2965 | Coenzyme Q9 | LC | 1.40 | 2.98 |
| b4039 | Coenzyme Q9 | LC | 1.53 | 2.13 | for the disclosure of the paragraphs [0499.0.0.17] and [0500.0.0.17] see paragraphs [0499.0.0.0] and [0500.0.0.0] above.

Example 15a

Engineering Ryegrass Plants by Over-Expressing b1551 from *Escherichia coli* or Homologs of b1551 from Other Organisms for the disclosure of the paragraphs [0502.0.0.17] to [0508.0.0.17] see paragraphs [0502.0.0.0] to [0508.0.0.0] above.

Example 15b

Engineering Soybean Plants by Over-Expressing b1551 from *Escherichia coli* or Homologs of b1551 from Other Organisms for the disclosure of the paragraphs [0510.0.0.17] to [0513.0.0.17] see paragraphs [0510.0.0.0] to [0513.0.0.0] above.

Example 15c

Engineering Corn Plants by Over-Expressing b1551 from *Escherichia coli* or Homologs of b1551 from Other Organisms for the disclosure of the paragraphs [0515.0.0.17] to [0540.0.0.17] see paragraphs [0515.0.0.0] to [0540.0.0.0] above.

Example 15d

Engineering Wheat Plants by Over-Expressing b1551 from *Escherichia coli* or Homologs of b1551 from Other Organisms for the disclosure of the paragraphs [0542.0.0.17] to [0544.0.0.17] see paragraphs [0542.0.0.0] to [0544.0.0.0] above.

Example 15e

Engineering Rapeseed/Canola Plants by Over-expressing b1551 from *Escherichia coli* or Homologs of b1551 from Other Organisms for the disclosure of the paragraphs [0546.0.0.17] to [0549.0.0.17] see paragraphs [0544.0.0.0] to [0549.0.0.0] above.

Example 15f

Engineering Alfalfa Plants by Over-Expressing b1551 from *Escherichia coli* or Homologs of b1551 from Other Organisms for the disclosure of the paragraphs [0551.0.0.17] to [0554.0.0.17] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII

TABLE VII

| ORF_NAME | Metabolite | MIN | MAX |
|---|---|---|---|
| b1704 | Coenzyme Q10 | 5.56 | 8.85 |
| b2600 | Coenzyme Q10 | 1.69 | 9.81 |

Table VII shows the increase in Coenzyme Q10 in genetically modified corn plants expressing the *Escherichia coli* nucleic acid sequence b1704 or b2600.

In one embodiment, in case the activity of the *Escherichia coli* protein b1704 or its homologs, e.g. a "3-deoxy-D-arabinoheptulosonate-7-phosphate synthase (DAHP synthetase), tryptophan-repressible", is increased in corn plants, preferably, an increase of the fine chemical Coenzyme Q10 between 446% and 785% is conferred.

In one embodiment, in case the activity of the *Escherichia coli* protein b2600 or its homologs, e.g. a "bifunctional chorismate mutase/prephenate dehydrogenase", is increased in corn plants, preferably, an increase of the fine chemical Coenzyme Q10 acid between 69% and 881% is conferred.

for the disclosure of this paragraph see [0554.2.0.0] above.

for the disclosure of this paragraph see [0555.0.0.0] above.

for the disclosure of this paragraph see [0001.0.0.0].

Plants produce several important secondary metabolites from phenylalanine through the phenylpropanoid pathway. Such substances include flavonoids, lignins, tannins, salicylic acid and hydroxycinnamic acid esters. Recent work on the phenylpropanoid pathway has shown that the traditional view of lignin biosynthesis is incorrect. Although the hydroxylation and methylation reactions of the pathway were long thought to occur at the level of the free hydroxycinnamic acids, it turns now out, that the enzymes catalyzing phenylpropanoid 3-hydroxylation and 3-O-methylation reactions uses shikimate and CoA conjugates as substrates. The recent cloning of a aldehyde dehydrogenase involved in ferulic acid and sinapic acid biosynthesis suggest that both substances are derived at least in part through oxidation of coniferaldehyde and sinapaldehyde (see Nair et al., 2004, Plant Cell, 16, 544-554 and citations therein).

Ferulic acid is a substance found in the seeds and leaves of most plants, especially in the brans of grasses such as wheat, rice, and oats. Its chemical structure strongly resembles that of curcumin, the substance responsible for the yellow color of the spice turmeric.

The amount of ferulic acid in plant materials varies widely depending on the species and growing conditions; supplements are therefore a more reliable source of this substance than food or unprocessed herbal materials.

Ferulic acid has antioxidant properties that make it an important anti-aging supplement, and they also contribute to ferulic acid's other potential uses. These include applications in diabetes, cardiovascular disease, cancer, neuroprotection, bone degeneration, menopause, immunity, and (perhaps) athletic performance.

In male rats fed a high cholesterol diet, ferulic acid supplementation significantly lowered total cholesterol and triglyceride concentrations in the blood, as compared to a control group. Moreover, HDL ('good cholesterol') is increased with ferulic acid supplementation.

Like many other dietary substances, ferulic acid is an antioxidant—but it is an unusually good one. It is especially good at neutralizing the free radicals known as 'superoxide', 'hydroxyl radical', and 'nitric oxide'. It acts synergistically with other antioxidants, giving them extra potency. In addition, ferulic acid can be activated to even higher antioxidant activity by exposure to UV light, suggesting that it might help to protect skin from sun damage.

In microbiological applications ferulic acid is useful as a substrate for vanillin production, as for example described in WO 9735999 or DE19960106 or for melanin production (WO 9720944).

Cinnamic acids, which include caffeic and ferulic acids, are also powerful antioxidants. Experiments have found that these compounds can stop the growth of cancer cells.

In addition sinapic acid is an intermediate in syringyl lignin biosynthesis in angiosperms, and in some taxa serves as a precursor for soluble secondary metabolites. The biosynthesis and accumulation of the sinapate esters sinapoylglucose, sinapoylmalate, and sinapoylcholine are developmentally regulated in at least *Arabidopsis* and other members of the Brassicaceae (Ruegger et. al., 1999, 119(1): 101-10, 1999).

Due to these interesting physiological roles and agrobiotechnological potential of ferulic acid or sinapic acid there is a need to identify the genes of enzymes and other proteins involved in ferulic acid or sinapic acid metabolism, and to generate mutants or transgenic plant lines with which to modify the ferulic acid or sinapic acid content in plants.

One way to increase the productive capacity of biosynthesis is to apply recombinant DNA technology. Thus, it would be desirable to produce ferulic acid or sinapic acid in plants. That type of production permits control over quality, quantity and selection of the most suitable and efficient producer organisms. The latter is especially important for commercial production economics and therefore availability to consumers. In addition it is desirable to produce ferulic acid or sinapic acid in plants in order to increase plant productivity and resistance against biotic and abiotic stress as discussed before.

Methods of recombinant DNA technology have been used for some years to improve the production of fine chemicals in microorganisms and plants by amplifying individual biosynthesis genes and investigating the effect on production of fine chemicals. It is for example reported, that the xanthophyll astaxanthin could be produced in the nectaries of transgenic tobacco plants. Those transgenic plants were prepared by *Argobacterium tumifaciens*-mediated transformation of tobacco plants using a vector that contained a ketolase-encoding gene from *H. pluvialis* denominated crtO along with the Pds gene from tomato as the promoter and to encode a leader sequence. Those results indicated that about 75 percent of the carotenoids found in the flower of the transformed plant contained a keto group.

Thus, it would be advantageous if an algae, plant or other microorganism were available which produce large amounts ferulic acid or sinapic acid. The invention discussed hereinafter relates in some embodiments to such transformed prokaryotic or eukaryotic microorganisms.

It would also be advantageous if plants were available whose roots, leaves, stem, fruits or flowers produced large amounts of ferulic acid or sinapic acid. The invention discussed hereinafter relates in some embodiments to such transformed plants.

Therefore improving the quality of foodstuffs and animal feeds is an important task of the food-and-feed industry. This is necessary since, for example ferulic acid or sinapic acid, as mentioned above, which occur in plants and some microorganisms are limited with regard to the supply of mammals. Especially advantageous for the quality of foodstuffs and animal feeds is as balanced as possible a specific ferulic acid or sinapic acid profile in the diet since an excess of ferulic acid or sinapic acid above a specific concentration in the food has a positive effect. A further increase in quality is only possible via addition of further ferulic acid or sinapic acid, which are limiting.

To ensure a high quality of foods and animal feeds, it is therefore necessary to add ferulic acid or sinapic acid in a balanced manner to suit the organism.

Accordingly, there is still a great demand for new and more suitable genes which encode enzymes or other proteins which participate in the biosynthesis of ferulic acid or sinapic acid and make it possible to produce them specifically on an industrial scale without unwanted byproducts forming. In the selection of genes for biosynthesis two characteristics above all are particularly important. On the one hand, there is as ever a need for improved processes for obtaining the highest possible contents of ferulic acid or sinapic acid; on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is a ferulic acid or sinapic acid. Accordingly, in the present invention, the term "the fine chemical" as used herein relates to a ferulic acid or sinapic acid. Further, the term "the fine chemicals" as used herein also relates to fine chemicals comprising ferulic acid or sinapic acid.

In one embodiment, the term "the fine chemical" or "the respective fine chemical" means at least one chemical compound with ferulic acid or sinapic acid activity.

In one embodiment, the term "the fine chemical" means ferulic acid. In one embodiment, the term "the fine chemical" means sinapic acid depending on the context in which the term is used. Throughout the specification the term "the fine chemical" means ferulic acid or sinapic acid, its salts, ester, thioester or in free form or bound to other compounds such sugars or sugar polymers, like glucoside, e.g. diglucoside.

Accordingly, the present invention relates to a process for the production of sinapic acid or ferulic acid which comprises (a) increasing or generating the activity of a protein as shown in table II, application no. 19, column 3 encoded by the nucleic acid sequences as shown in table I, application no. 19, column 5, in an organelle of a microorganism or plant, or (b) increasing or generating the activity of a protein as shown in table II, application no. 19, column 3 encoded by the nucleic acid sequences as shown in table I, application no. 19, column 5 in the plastid of a microorganism or plant, or in one or more parts thereof; and (c) growing the organism under conditions which permit the production of the fine chemical, thus sinapic acid or ferulic acid or fine chemicals comprising-sinapic acid or ferulic acid, in said organism or in the culture medium surrounding the organism.

Accordingly, the term "the fine chemical" means in one embodiment "sinapic acid or ferulic acid" in relation to all sequences listed in Table I to IV, application no. 19

In another embodiment the present invention is related to a process for the production of sinapic acid or ferulic acid, which comprises (a) increasing or generating the activity of a protein as shown in table II, application no. 19 column 3 encoded by the nucleic acid sequences as shown in table I, application no. 19, column 5, in an organelle of a non-human organism, or (b) increasing or generating the activity of a protein as shown in table II, application no. 19, column 3 encoded by the nucleic acid sequences as shown in table I, application no. 19, column 5, which are joined to a nucleic acid sequence encoding a transit peptide in a non-human organism, or in one or more parts thereof; or (c) increasing or generating the activity of a protein as shown in table II, application no. 19, column 3 encoded by the nucleic acid sequences as shown in table I, application no. 19, column 5, which are joined to a nucleic acid sequence encoding chloroplast localization sequence, in a non-human organism, or in one or more parts thereof, and (d) growing the organism under conditions which permit the production of sinapic acid or ferulic acid in said organism.

Advantagously the activity of the protein as shown in table II, application no. 19, column 3 encoded by the nucleic acid sequences as shown in table I, application no. 19, column 5 is increased or generated in the abovementioned process in the plastid of a microorganism or plant.

for the disclosure of the paragraphs [0019.0.0.18] to [0024.0.0.18] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 19, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 19, column 3 and its homologs as disclosed in table I, application no. 19, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 19, column 3 and its homologs as disclosed in table I, application no. 19, columns 5 and 7.

for the disclosure of the paragraphs [0027.0.0.18] to [0029.0.0.18] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 19, columns 5 and 7. The person skilled in the art is able to join said sequences in a functional manner. Advantageously the transit peptide part is cleaved off from the protein part shown in table II, application no. 18, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 19, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 19, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 19, columns 5 and 7.

Furthermore the skilled worker is aware of the fact that there is not a need for such short sequences in the expression of the genes.

Table V: Examples of transit peptides disclosed by von Heijne et al.: for the disclosure of the Table V see paragraphs [0030.2.0.0] above.

Alternatively to the targeting of the sequences shown in table II, application no. 19, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 19, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.18] and [0030.3.0.18] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 19, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 19, columns 5 and 7 or a sequence encoding a protein, as depicted in table II, application no. 19, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table, 1, application no. 19, columns 5 and 7 or a sequence encoding a protein, as depicted in table II, application no. 19, columns 5 and 7 in such a manner that the viroid sequence transports a sequence transcribed from a sequence as depicted in table 1 application no. 19, columns 5 and 7 or a sequence encoding a protein as depicted in table II, application no. 19, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 19, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 19, columns 5 and 7.

In a preferred embodiment of the invention the nucleic acid sequences as shown in table I, application no. 19, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 19, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.18] and [0032.0.0.18] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 19, column 3. Preferably the modification of the activity of a protein as shown in table II, application no. 19, column 3 or their combination can be achieved by joining the protein to a transit peptide.

Surprisingly it was found, that the transgenic expression of the *E. coli* proteins shown in table II, application no. 19, column 3 in plastids of a plant such as *Arabidopsis thalaiana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *E. coli* protein b0931, b1556 or b1797 in combination with a plastidal targeting sequence in *Arabidopsis thalaiana* conferred an increase in sinapic acid.

Surprisingly it was found, that the transgenic expression of the *Saccharomyces cerevisiae* protein shown in table II, application no. 19, column 3 in plastids of a plant such as *Arabidopsis thalaiana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *Saccharomyces cerevisiae* protein YDR035W in combination with a plastidal targeting sequence in *Arabidopsis thalaiana* conferred an increase in ferulic acid.

for the disclosure of this paragraph see paragraph [0035.0.0.0] above.

The sequence of b0931(PIR:JQ0756) from *Escherichia coli* has been published in Blattner et al., Science 277 (5331), 1453-1474 (1997), and its activity is being defined as "nicotinate phosphoribosyltransferase". Accordingly, in one embodiment, the process of the present invention comprises the use of a "nicotinate phosphoribosyltransferase" or its homolog, e.g. as shown herein, for the production of the fine chemical, meaning of sinapic acid, in particular for increasing the amount of sinapic acid in free or bound form in an organism or a part thereof, as mentioned. In one embodiment, in the process of the present invention the activity of a b0931 protein is increased or generated, e.g. from *Escherichia coli* or a homolog thereof, preferably linked at least to one transit peptide as mentioned for example in table V.

In another embodiment, in the process of the present invention the activity of a b0931 protein is increased or generated in a subcellular compartment of the organism or organism cell such as in an organelle like a plastid or mitochondria.

The sequence of b1556 from *Escherichia coli* (Accession NP_416074) has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of sinapic acid, in particular for increasing the amount of sinapic acid in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1797 from *Escherichia coli* (Accession PIR:E64940) has been published in Blattner et al., Science 277 (5331), 1453-1474 (1997), and its activity is being defined as "putative tellurite resistance protein". Accordingly, in one embodiment, the process of the present invention comprises the use of a "putative tellurite resistance protein" or its homolog, e.g. as shown herein, for the production of the fine chemical, meaning of sinapic acid, in particular for increasing the amount of sinapic acid in free or bound form in an organism or a part thereof, as mentioned. In one embodiment, in the process of the present invention the activity of a b1797 protein is increased or generated, e.g. from *Escherichia coli* or a homolog thereof, preferably linked at least to one transit peptide as mentioned for example in table V.

In another embodiment, in the process of the present invention the activity of a b1797 protein is increased or generated in a subcellular compartment of the organism or organism cell such as in an organelle like a plastid or mitochondria.

The sequence of YDR035W from *Saccharomyces cerevisiae* (Accession NP_010320) has been published in Goffeau, A. et al., Science 274 (5287), 546-547 (1996), and its activity is being defined as "3-deoxy-D-arabino-heptulosonate 7phosphate (DAHP) synthase". Accordingly, in one embodiment, the process of the present invention comprises the use of a "3-deoxy-D-arabino-heptulosonate 7phosphate (DAHP) synthase" or its homolog, e.g. as shown herein, for the production of the fine chemical, meaning of ferulic acid, in particular for increasing the amount of ferulic acid in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of a YDR035W protein is increased or generated in a subcellular compartment of the organism or organism cell such as in an organelle like a plastid or mitochondria.

In one embodiment, the homolog of the b0931, b1556, and b1797 is a homolog having said activity and being derived from bacteria. In one embodiment, the homolog of the b0931, b1556, and b1797 is a homolog having said activity and being derived from Proteobacteria. In one embodiment, the homolog of the b0931, b1556, and b1797 is a homolog having said activity and being derived from Gammaproteobacteria. In one embodiment, the homolog of the b0931, b1556, and b1797 is a homolog having said activity and being derived from Enterobacteriales. In one embodiment, the homolog of the b0931, b1556, and b1797 is a homolog having said activity and being derived from Enterobacteriaceae. In one embodiment, the homolog of the b0931, b1556, and b1797 is a homolog having said activity and being derived from *Escherichia*, preferably from *Escherichia coli*.

Homologs of the polypeptide disclosed in table II, application no. 19, column 3 may be the polypeptides encoded by the nucleic acid molecules indicated in table I, application no. 19, column 7, resp., or may be the polypeptides indicated in table II, application no. 19, column 7, resp.

for the disclosure of this paragraph see paragraph [0038.0.0.0] above.

In accordance with the invention, a protein or polypeptide has the "activity of an protein as shown in table II, application no. 19, column 3" if its de novo activity, or its increased expression directly or indirectly leads to an increased in the level of the fine chemical indicated in the respective line of table II, application no. 19, column 6 "metabolite" in the organism or a part thereof, preferably in a cell of said organism, more preferably in an organelle such as a plastid or mitochondria of said organism. The protein has the above mentioned activities of a protein as shown in table II, application no. 19, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 19, column 3, or which has at least 10% of the original enzymatic activity, preferably 20%, particularly preferably 30%, most particularly preferably 40% in comparison to a protein as shown in the respective line of table II, application no. 19, column 3 of *E. coli*.

for the disclosure of the paragraphs [0040.0.0.18] to [0047.0.0.18] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 19, column 3 its biochemical or genetical causes and the increased amount of the respective fine chemical.

for the disclosure of the paragraphs [0049.0.0.18] to [0051.0.0.18] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 19, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.18] to [0058.0.0.18] see paragraphs [0053.0.0.0] to [0058.0.0.0] above.

In case the activity of the *Escherichia coli* protein b0931 or its homologs, e.g. a "nicotinate phosphoribosyltransferase" is increased, advantageously in an organelle such as a plastid or mitochondria, preferably, an increase of the fine chemical, preferably of free sinapic acid between 29% and 97% or more is conferred.

In case the activity of the *Escherichia coli* protein b1556 or its homologs, e.g. a "Qin prophage" is increased, advantageously in an organelle such as a plastid or mitochondria, preferably, an increase of the fine chemical, preferably of free sinapic acid between 40% and 88% or more is conferred.

In case the activity of the *Escherichia coli* protein b1797 or its homologs, e.g. a "putative tellurite resistance protein" is increased, advantageously in an organelle such as a plastid or mitochondria, preferably, an increase of the fine chemical, preferably of free sinapic acid between 29% and 36% or more is conferred.

In case the activity of the *Saccharomyces cerevisiae* protein YDR035W or its homologs, e.g. a "3-deoxy-D-arabino-heptulosonate 7-phosphate (DAHP) synthase" is increased, advantageously in an organelle such as a plastid or mitochondria, preferably, an increase of the fine chemical, preferably of free ferulic acid between 37% and 75% or more is conferred.

for the disclosure of the paragraphs [0061.0.0.18] and [0062.0.0.18] see paragraphs [0061.0.0.0] and [0062.0.0.0] above.

A protein having an activity conferring an increase in the amount or level of the fine chemical, preferably upon targeting to the plastids, has in one embodiment the structure of the polypeptide described herein, in particular of the polypeptides comprising the consensus sequence shown in table IV, application no. 19, column 7 or of the polypeptide as shown in the amino acid sequences as disclosed in table II, application no. 19, columns 5 and 7 or the functional homologues thereof as described herein, or is encoded by the nucleic acid molecule characterized herein or the nucleic acid molecule according to the invention, for example by the nucleic acid molecule as shown in table I, application no. 19, columns 5 and 7 or its herein described functional homologues and has the herein mentioned activity.

For the purposes of the present invention, the reference to the fine chemical, e.g. to the term "sinapic acid or ferulic acid", also encompasses the corresponding salt and esters, ethers or sinapic acid or ferulic acid bound to proteins, e.g. lipoproteins or other components or cross-linked to cell wall material like cellulose, hemicellulose or pectins.

for the disclosure of the paragraphs [0065.0.0.18] and [0066.0.0.18] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 19, columns 5 and 7 or its homologs activity having herein-mentioned sinapic acid or ferulic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 19, columns 5 and 7, e.g. a nucleic acid sequence encoding a polypeptide having the activity of a protein as indicated in table II, application no. 19, columns 5 and 7 or its homologs activity or of a mRNA encoding the polypeptide of the present invention having herein-mentioned sinapic acid or ferulic acid increasing activity; and/or c) increasing the specific activity of a protein conferring the increased expression of a protein encoded by the nucleic acid molecule of the invention or of the polypeptide of the present invention having herein-mentioned sinapic acid or ferulic acid increasing activity, e.g. of a polypeptide having the activity of a protein as indicated in table II, application no. 19, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned sinapic acid or ferulic acid increasing activity, e.g. of a polypeptide having the activity of a protein as indicated in table II, application no. 19, columns 5 and 7 or its homologs activity; and/or e) stimulating activity of a protein conferring the increased expression of a protein encoded by the nucleic acid molecule of the present invention or a polypeptide of the present invention having herein-mentioned sinapic acid or ferulic acid increasing activity, e.g. of a polypeptide having the activity of a protein as indicated in table II, application no. 19, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned sinapic acid or ferulic acid increasing activity, e.g. of a polypeptide having the activity of a protein as indicated in table II, application no. 19, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned sinapic acid or ferulic acid increasing activity, e.g. of a polypeptide having the activity of a protein as indicated in table II, application no. 19, columns 5 and 7 or its homologs activity; and/or h) increasing the expression of the endogenous gene encoding the polypeptide of the invention, e.g. a polypeptide having the activity of a protein as indicated in table II, application no. 19, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned sinapic acid or ferulic acid increasing activity, e.g. of polypeptide having the activity of a protein as indicated in table II, application no. 19, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned sinapic acid or ferulic acid increasing activity, e.g. of a polypeptide having the activity of a protein as indicated in table II, application no. 19, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned sinapic acid or ferulic acid increasing activity, e.g. of a polypeptide having the activity of a protein as indicated in table II, application no. 19, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the respective fine chemical as indicated in column 6 of application no. 19 in Table I to IV, resp., after increasing the expression or activity of the encoded polypeptide preferably in organelles such as plastids or having the activity of a polypeptide having an activity as the protein as shown in table II, application no. 19, column 3 or its homologs. Preferably the increase of the fine chemical takes place in plastids.

for the disclosure of the paragraphs [0069.0.0.18] to [0079.0.0.18] see paragraphs [0069.0.0.0] to [0079.0.0.0] above.

The activation of an endogenous polypeptide having above-mentioned activity, e.g. having the activity of a protein as shown in table II, application no. 19, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 19, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 19, column 3. The expression of the chimeric transcription factor in a organism, in particular in a plant, leads to a specific expression of the protein as shown in table II, application no. 19, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.18] to [0084.0.0.18] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous sinapic acid or ferulic acid containing composition comprising a higher content of different phenolic compounds, like salicylic acid, benzoic acid, cinnamic acid and caffeic acid which have defense, antioxidant or other useful activities. It can also be advantageous to increase the level of a metabolic precursor of sinapic acid or ferulic acid in the organism or part thereof.

Depending on the choice of the organism used for the process according to the present invention, for example a microorganism or a plant, compositions or mixtures of various carotenoids and sinapic acid or ferulic acid can be produced.

for the disclosure of this paragraph see paragraph [0086.0.0.0] above.

By influencing the metabolism thus, it is possible to produce, in the process according to the invention, further advantageous compounds. Examples of such compounds are carotenoids, e.g. carotenes or xanthophylls, in particular ketocarotenoids, or hydrocarotenoids, e.g. beta-cryptoxanthin, zeaxanthin, astaxanthin, lycopene, alpha-carotene, or beta-carentene, or compounds for which sinapic acid or ferulic acid is a precursor compound.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 19, column 3 or of a polypeptide being encoded by the nucleic acid molecule of the present invention and described below, e.g. conferring an increase of the respective fine chemical as indicated in any one of Tables I to IV, application no. 19, column 6 "metabolite" in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and
if desired, recovering, optionally isolating, the respective free and/or bound fine chemical as indicated in any one of Tables I to IV, application no. 19, column 6 "metabolite".

The organism, in particular the microorganism, non-human animal, the plant or animal cell, the plant or animal tissue or the plant is advantageously grown in such a way that it is not only possible to recover, if desired isolate the free or bound respective fine chemical but as option it is also possible to produce, recover and, if desired isolate, other free or/and bound derivatives of sinapic acid or ferulic acid.

for the disclosure of the paragraphs [0090.0.0.18] to [0097.0.0.18] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 19, columns 5 and 7 or a derivative thereof, or
b) a genetic regulatory element, for example a promoter, which is functionally linked to the nucleic acid sequence as shown table I, application no. 19, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 19, columns 5 and 7 joined to a nucleic acid sequence encoding a transit peptide, or a targeting nucleic acid sequence which directs the nucleic acid sequences disclosed in table I, application no. 19, columns 5 and 7 to the organelle preferentially the plastids. Altenatively the inventive nucleic acids sequences consist advantageously of the nucleic acid sequences as depicted in the sequence protocol and disclosed in table I, application no. 19, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose sinapic acid or ferulic acid content is modified advantageously owing to the nucleic acid molecule of the present invention expressed. This is important for plant breeders since, for example, the nutritional value of plants for poultry is dependent on the abovementioned sinapic acid or ferulic acid content as antioxidant source in feed. Further, this is also important for the production of cosmetic compostions since, for example, the antioxidant level of plant extracts is depending on the abovementioned sinapic acid or ferulic acid content and the general amount of antioxidants e.g. as vitamins.

After the activity of the protein as shown in table II, application no. 19, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.18] to [0110.0.0.18] see paragraphs [0102.0.0.0] to [0110.0.0.0] above.

In a preferred embodiment, the respective fine chemical as indicated in any one of Tables I to IV, application no. 19, column 6 "metabolite" (sinapic acid or ferulic acid) is produced in accordance with the invention and, if desired, is isolated. The production of further phenolic compounds or compound with antioxidant activities like for example vitamins, provitamins or carotenoids, e.g. carotenes or xanthophylls, or mixtures thereof or mixtures with other compounds by the process according to the invention is advantageous.

Thus, the content of plant components and preferably also further impurities is as low as possible, and the abovementioned sinapic acid or ferulic acid are obtained in as pure form as possible. In these applications, the content of plant components advantageously amounts to less than 10%, preferably 1%, more preferably 0.1%, very especially preferably 0.01% or less.

In another preferred embodiment of the invention a combination of the increased expression of the nucleic acid sequence or the protein of the invention together with the transformation of a protein or polypeptide or a compound, which functions as a sink for the desired fine chemical, for example sinapic acid or ferulic acid in the organism, is useful to increase the production of the respective fine chemical (as indicated in any one of Tables I to IV, application no. 19, column 6 "metabolite").

In the case of the fermentation of microorganisms, the abovementioned sinapic acid or ferulic acid may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, spray granulation or by other methods. Preferably the respective fine chemical as indicated for application no. 19 in any one of Tables I to IV, column 6 "metabolite" or the sinapic acid or ferulic acid comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the sinapic acid or ferulic acid, synthesized in the process according to the invention can advantageously be marketed directly without there being any need for sinapic acid or ferulic acid synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

The site of sinapic acid or ferulic acid biosynthesis in plants is, inter alia, the leaf tissue so that the isolation of leafs makes sense. However, this is not limiting, since the expression may also take place in a tissue-specific manner in all of the remaining parts of the plant, in particular in seeds. A further preferred embodiment therefore relates to a seed-specific isolation of sinapic acid or ferulic acid.

However, the respective fine chemical as indicated for application no. 19 in any one of Tables I to IV, column 6, "metabolite" produced in the process according to the invention can also be isolated from the organisms, advantageously plants, in the form of their esters, ether or pyranosides, as extracts, e.g. ether, alcohol, or other organic solvents or water containing extract and/or free sinapic acid or ferulic acid. The respective fine chemical produced by this process can be obtained by harvesting the organisms, either from the crop in which they grow, or from the field. This can be done via pressing or extraction of the plant parts, preferably the plant seeds. To increase the efficiency of oil extraction it is beneficial to clean, to temper and if necessary to hull and to flake the plant material especially the seeds. e.g. the esters or pyranosides, extracts, e.g. ether, alcohol, or other organic solvents or water containing extract and/or free sinapic acid or ferulic acid can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as preferably warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid.

Because sinapic acid or ferulic acid in microorganisms may be localized intracellularly, their recovery essentials comes down to the isolation of the biomass. Well-established approaches for the harvesting of cells include filtration, centrifugation and coagulation/flocculation as described herein.

Sinapic acid or ferulic acid can for example be analyzed advantageously via HPLC, LC or GC separation methods and detected by MS oder MSMS methods. The unambiguous detection for the presence of sinapic acid or ferulic acid containing products can be obtained by analyzing recombinant organisms using analytical standard methods: GC, GC-MS, or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). The material to be analyzed can be disrupted by sonication, grinding in a glass mill, liquid nitrogen and grinding, cooking, or via other applicable methods; see also Biotechnology of Vitamins, Pigments and Growth Factors, Edited by Erik J. Vandamme, London, 1989, p. 96 to 103.

In a preferred embodiment, the present invention relates to a process for the production of the respective fine chemical as indicated for application no. 19 in any one of Tables I to IV, column 6 "metabolite", comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 19, columns 5 and 7 or a fragment thereof, which confers an increase in the amount of the respective fine chemical in an organism or a part thereof;

b) nucleic acid molecule comprising, preferably at least the mature form, of the nucleic acid molecule shown in table I, application no. 19, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybridizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;

h) nucleic acid molecule comprising a nucleic acid molecule which is obtained by amplifying nucleic acid molecules from a cDNA library or a genomic library using the primers shown in table III, application no. 19, column 7 and conferring an increase in the amount of the respective fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;

j) nucleic acid molecule which encodes a polypeptide comprising the consensus sequence shown in table IV, application no. 19, column 7 and conferring an increase in the amount of the respective fine chemical in an organism or a part thereof;

k) nucleic acid molecule comprising one or more of the nucleic acid molecule encoding the amino acid sequence of a polypeptide encoding a domain of the polypeptide shown in table II, application no. 19, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in table IA, application no. 19, columns 5 and 7 by one or more nucleotides. In one embodiment, the nucleic acid molecule used in the process of the invention does not consist of the sequence indicated in table IA, application no. 19, columns 5 and 7. In one embodiment, the nucleic acid molecule used in the process of the invention is less than 100%, 99.999%, 99.99%, 99.9% or 99% identical to a sequence indicated in table IA, application no. 19, columns 5 and 7. In another embodiment, the nucleic acid molecule does not encode a polypeptide of a sequence indicated in table IIA, application no. 19, columns 5 and 7.

In one embodiment, the nucleic acid molecule used in the process of the invention distinguishes over the sequence indicated in table IB, application no. 19, columns 5 and 7, by one or more nucleotides. In one embodiment, the nucleic acid molecule used in the process of the invention does not consist of the sequence indicated in table IB, application no. 19, columns 5 and 7. In one embodiment, the nucleic acid molecule used in the process of the invention is less than 100%, 99.999%, 99.99%, 99.9% or 99% identical to a sequence indicated in table IB, application no. 19, columns 5 and 7. In another embodiment, the nucleic acid molecule does not encode a polypeptide of a sequence indicated in table IIB, application no. 19, columns 5 and 7.

In one embodiment, the nucleic acid molecule used in the process distinguishes over the sequence shown in table I, application no. 19, columns 5 and 7 by one or more nucleotides or does not consist of the sequence shown in table I, application no. 19, columns 5 and 7. In one embodiment, the nucleic acid molecule of the present invention is less than 100%, 99.999%, 99.99%, 99.9% or 99% identical to the sequence shown in table I, application no. 19, columns 5 and 7. In another embodiment, the nucleic acid molecule does not encode a polypeptide of the sequence shown in table II, application no. 19, columns 5 and 7.

for the disclosure of the paragraphs [0118.0.0.18] to [0120.0.0.18] see paragraphs [0118.0.0.0] to [0120.0.0.0] above.

The expression of nucleic acid molecules with the sequence shown in table I, application no. 19, columns 5 and 7, or nucleic acid molecules which are derived from the amino acid sequences shown in table II, application no. 19, columns 5 and 7 or from polypeptides comprising the consensus sequence shown in table IV, application no. 19, column 7, or their derivatives or homologues encoding polypeptides with the enzymatic or biological activity of a protein as shown in table II, application no. 19, column 3, and conferring an increase of the respective fine chemical (column 6 of application no. 19 in any one of Tables I to IV) after increasing its plastidic expression and/or specific activity in the plastids is advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 19, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 19, column 3 and which confer an increase in the level of the respective fine chemical indicated in table II, application no. 19, column 6 by being expressed either in the cytsol or in an organelle such as a plastid or mitochondria or both, preferably in plastids, and the gene product being localized in the plastid and other parts of the cell or in the plastid as described above.

for the disclosure of the paragraphs [0126.0.0.18] to [0133.0.0.18] see paragraphs [0126.0.0.0] to [0133.0.0.0] above.

Production strains which are also advantageously selected in the process according to the invention are microorganisms selected from the group of green algae, like *Spongioccoccum exentricum, Chlorella sorokiniana* (pyrenoidosa, 7-11-05), or algae of the genus *Haematococcus, Phaedactylum tricornatum, Volvox* or *Dunaliella*.

The invention also contemplates embodiments in which the sinapic acid or ferulic acid or sinapic acid or ferulic acid precursor compounds in the production of the respective fine chemical, are present in a photosynthetic active organisms chosen as the host; for example, cyanobacteria, moses, algae or plants which, even as a wild type, are capable of producing sinapic acid or ferulic acid.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 19, columns 5 and 7 or the functional homologues thereof as described herein, preferably conferring above-mentioned activity, i.e. conferring an increase of the respective fine chemical after increasing its plastidic activity, e.g. after increasing the activity of a protein as shown in table II, application no. 19, column 3 by—for example— expression either in the cytsol or in an organelle such as a plastid or mitochondria or both, preferably in plastids and the gene product, e.g. the polypeptide, being localized in the plastid and other parts of the cell or in the plastid as described above.

forthe disclosure of the paragraphs [0135.0.0.18] to [0140.0.0.18] see paragraphs [0135.0.0.0] to [0140.0.0.0] above.

Synthetic oligonucleotide primers for the amplification, e.g. as shown in table III, application no. 19, column 7, by means of polymerase chain reaction can be generated on the basis of a sequence shown herein, for example the sequence shown in table I, application no. 19, columns 5 and 7 or the sequences derived from table II, application no. 19, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 19, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 19, column 3 or further functional homologs of the polypeptide of the invention from other organisms.

for the disclosure of the paragraphs [0144.0.0.18] to [0151.0.0.18] see paragraphs [0144.0.0.0] to [0151.0.0.0] above.

Polypeptides having above-mentioned activity, i.e. conferring the increase of the respective fine chemical indicated in table I, application no. 19, column 6, and being derived from other organisms, can be encoded by other DNA sequences which hybridize to the sequences shown in table I, application no. 19, columns 5 and 7, preferably of table IB, application no. 19, columns 5 and 7 under relaxed hybridization conditions and which code on expression for peptides having the respective fine chemical, i.e. sinapic acid or ferulic acid increasing activity, when expressed in a way that the gene product, e.g. the polypeptide, being localized in the plastid and other parts of the cell or in the plastid as described above.

for the disclosure of the paragraphs [0153.0.0.18] to [0159.0.0.18] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 19, columns 5 and 7, preferably shown in table IB, application no. 19, columns 5 and 7 is one which is sufficiently complementary to one of the nucleotide sequences shown in table I, application no. 19, columns 5 and 7, preferably shown in table IB, application no. 19, columns 5 and 7 such that it can hybridize to one of the nucleotide sequences shown in table I, application no. 19, columns 5 and 7, preferably shown in table IB, application no. 19, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 19, columns 5 and 7, preferably shown in table IB, application no. 19, columns 5 and 7, or a portion thereof and preferably has above mentioned activity, in particular having a respective fine chemical increasing activity after increasing the activity or an activity of a gene product as shown in table II, application no. 19, column 3 by for example expression either in the cytsol or in an organelle such as a plastid or mitochondria or both, preferably in plastids, and the gene product, e.g. the polypeptide, being localized in the plastid and other parts of the cell or in the plastid as described above.

The nucleic acid molecule of the invention comprises a nucleotide sequence which hybridizes, preferably hybridizes under stringent conditions as defined herein, to one of the nucleotide sequences shown in table I, application no. 19, columns 5 and 7, preferably shown in table IB, application no. 19, columns 5 and 7, or a portion thereof and encodes a protein having above-mentioned activity, e.g. conferring of a sinapic acid or ferulic acid increase by for example expression either in the cytsol or in an organelle such as a plastid or mitochondria or both, preferably in plastids, and optionally, the activity of a protein as shown in table II, application no. 19, column 3, and the gene product, e.g. the polypeptide, being localized in the plastid and other parts of the cell or in the plastid as described above.

Moreover, the nucleic acid molecule of the invention can comprise only a portion of the coding region of one of the sequences shown in table I, application no. 19, columns 5 and 7, preferably shown in table IB, application no. 19, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the respective fine chemical indicated in Table I, application no. 19, column 6, if its activity is increased by for example expression either in the cytsol or in an organelle such as a plastid or mitochondria or both, preferably in plastids, and the gene product, e.g. the polypeptide, being localized in the plastid and other parts of the cell or in the plastid as described above. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 19, columns 5 and 7, an anti-sense sequence of one of the sequences, e.g., set forth in table I, application no. 19, columns 5 and 7, preferably shown in table IB, application no. 19, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 19, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 19, columns 5 and 7 such that the protein or portion thereof maintains the ability to participate in the fine chemical production, in particular sinapic acid or ferulic acid increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 19, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 19, columns 5 and 7 and having above-mentioned activity, e.g. conferring preferably the increase of the respective fine chemical by for example expression either in the cytsol or in an organelle such as a plastid or mitochondria or both, preferably in plastids, and the gene product, e.g. the polypeptide, being localized in the plastid and other parts of the cell or in the plastid as described above.

for the disclosure of the paragraphs [0168.0.0.18] and [0169.0.0.18] see paragraphs [0168.0.0.0] and [0169.0.0.0] above.

The invention further relates to nucleic acid molecules that differ from one of the nucleotide sequences shown in table I, application no. 19, columns 5 and 7 (and portions thereof) due to degeneracy of the genetic code and thus encode a polypeptide of the present invention, in particular a polypeptide having above mentioned activity, e.g. conferring an increase in the respective fine chemical in a organism, e.g. as that polypeptides depicted by the sequence shown in table II, application no. 19, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 19, columns 5 and 7 or the functional homologues. In a still further embodiment, the nucleic acid molecule of the invention encodes a full length protein which is substantially homologous to an amino acid sequence shown in table II, application no. 19, columns 5 and 7 or the functional homologues. However, in a preferred embodiment, the nucleic acid molecule of the present invention does not consist of the sequence shown in table I, application no. 19, columns 5 and 7, preferably as indicated in table IA, application no. 19, columns 5 and 7. Preferably the nucleic acid molecule of the invention is a functional homologue or identical to a nucleic acid molecule indicated in table IB, application no. 19, columns 5 and 7.

for the disclosure of the paragraphs [0171.0.0.18] to [0173.0.0.18] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 19, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 19, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 19, columns 5 and 7.

for the disclosure of the paragraphs [0179.0.0.18] and [0180.0.0.18] see paragraphs [0179.0.0.0] and [0180.0.0.0] above.

Accordingly, the invention relates to nucleic acid molecules encoding a polypeptide having above-mentioned activity, e.g. conferring an increase in the the respective fine chemical in an organisms or parts thereof by for example expression either in the cytsol or in an organelle such as a plastid or mitochondria or both, preferably in plastids (as described), that contain changes in amino acid residues that are not essential for said activity. Such polypeptides differ in amino acid sequence from a sequence contained in the sequences shown in table II, application no. 19, columns 5 and 7, preferably shown in table IIA, application no. 19, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 19, columns 5 and 7, preferably shown in table IIA, application no. 19, columns 5 and 7 and is capable of participation in the increase of production of the fine chemical after increasing its activity, e.g. its expression by for example expression either in the cytsol or in an organelle such as a plastid or mitochondria or both, preferably in plastids and the gene product, e.g. the polypeptide, being localized in the plastid and other parts of the cell or in the plastid as described above. Preferably, the protein encoded by the nucleic acid molecule is at least about 60% identical to the sequence shown in table II, application no. 19, columns 5 and 7, preferably shown in table IIA, application no. 19, columns 5 and 7, more preferably at least about 70% identical to one of the sequences shown in table II, application no. 19, columns 5 and 7, preferably shown in table IIA, application no. 19, columns 5 and 7, even more preferably at least about 80%, 90%, 95% homologous to the sequence shown in table II, application no. 19, columns 5 and 7, preferably shown in table IIA, application no. 19, columns 5 and 7, and most preferably at least about 96%, 97%, 98%, or 99% identical to the sequence shown in table II, application no. 19, columns 5 and 7, preferably shown in table IIA, application no. 19, columns 5 and 7.

for the disclosure of the paragraphs [0182.0.0.18] to [0188.0.0.18] see paragraphs [0182.0.0.0] to [0188.0.0.0] above.

Functional equivalents derived from one of the polypeptides as shown in table II, application no. 19, columns 5 and 7, preferably shown in table IIB, application no. 19, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 19, columns 5 and 7, preferably shown in table IIB, application no. 19, columns 5 and 7 resp., according to the invention and are distinguished by essentially the same properties as the polypeptide as shown in table II, application no. 18, columns 5 and 7, preferably shown in table IIB, application no. 19, columns 5 and 7.

Functional equivalents derived from the nucleic acid sequence as shown in table I, application no. 19, columns 5 and 7, preferably shown in table IB, application no. 19, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 19, columns 5 and 7, preferably shown in table IIB, application no. 19, columns 5 and 7 resp., according to the invention and encode polypeptides having essentially the same properties as the polypeptide as shown in table II, application no. 19, columns 5 and 7, preferably shown in table IIB, application no. 19, columns 5 and 7.

for the disclosure of this paragraph see paragraph [0191.0.0.0] above.

A nucleic acid molecule encoding an homologous to a protein sequence of table II, application no. 19, columns 5 and 7, preferably shown in table IIB, application no. 19, columns 5 and 7 resp., can be created by introducing one or more nucleotide substitutions, additions or deletions into a nucleotide sequence of the nucleic acid molecule of the present invention, in particular of table I, application no. 19, columns 5 and 7, preferably shown in table IB, application no. 19, columns 5 and 7 resp., such that one or more amino acid substitutions, additions or deletions are introduced into the encoded protein. Mutations can be introduced into the encoding sequences of table I, application no. 19, columns 5 and 7, preferably shown in table IB, application no. 19, columns 5 and 7 resp., by standard techniques, such as site-directed mutagenesis and PCR-mediated mutagenesis.

for the disclosure of the paragraphs [0193.0.0.18] to [0196.0.0.18] see paragraphs [0193.0.0.0] to [0196.0.0.0] above.

Homologues of the nucleic acid sequences used, with the sequence shown in table I, application no. 19, columns 5 and 7, preferably shown in table IB, application no. 19, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 19, columns 5 and 7, preferably shown in table IB, application no. 19, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 19, columns 5 and 7, preferably shown in table IB, application no. 19, columns 5 and 7. It is preferred that the nucleic acid molecule comprises as little as possible other nucleotides not shown in any one of table I, application no. 19, columns 5 and 7, preferably shown in table IB, application no. 19, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 19, columns 5 and 7, preferably shown in table IB, application no. 19, columns 5 and 7.

Also preferred is that the nucleic acid molecule used in the process of the invention encodes a polypeptide comprising the sequence shown in table II, application no. 19, columns 5 and 7, preferably shown in table IIB, application no. 19, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 19, columns 5 and 7, preferably shown in table IIB, application no. 19, columns 5 and 7.

In one embodiment, the nucleic acid molecule of the invention or used in the process encodes a polypeptide comprising the sequence shown in table II, application no. 19, columns 5 and 7, preferably shown in table IIB, application no. 19, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 19, columns 5 and 7, preferably shown in table IB, application no. 19, columns 5 and 7.

Polypeptides (=proteins), which still have the essential biological or enzymatic activity of the polypeptide of the present invention conferring an increase of the respective fine chemical indicated in column 6 of Table I, application no. 19, i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 19, columns 5 and 7 expressed under identical conditions.

Homologues of table I, application no. 19, columns 5 and 7 or of the derived sequences of table II, application no. 19, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.18] to [0215.0.0.18] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 19, columns 5 and 7, preferably in table IIB, application no. 19, columns 5 and 7; or a fragment thereof conferring an increase in the amount of the fine chemical according to table IIB, application no. 19, column 6 in an organism or a part thereof b) nucleic acid molecule comprising, preferably at least the mature form, of the nucleic acid molecule shown in table I, application no. 19, columns 5 and 7, preferably in table IB, application no. 19, columns 5 and 7 or a fragment thereof conferring an increase in the amount of the fine chemical according to table IIB, application no. 19, column 6 in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical according to table IIB, application no. 19, column 6 in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical according to table IIB, application no. 19, column 6 in an organism or a part thereof;

e) nucleic acid molecule which hybridizes with a nucleic acid molecule of (a) to (c) under stringent hybridisation conditions and conferring an increase in the amount of the fine chemical according to table IIB, application no. 19, column 6 in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical according to table IIB, application no. 19, column 6 in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical according to table IIB, application no. 19, column 6 in an organism or a part thereof;

h) nucleic acid molecule comprising a nucleic acid molecule which is obtained by amplifying a cDNA library or a genomic library using the primers in table III, application no. 19, column 7 and conferring an increase in the amount of the fine chemical according to table IIB, application no. 19, column 6 in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 19, column 7 and conferring an increase in the amount of the fine chemical in an organism or a part thereof;

k) nucleic acid molecule encoding the amino acid sequence of a polypeptide encoding a domain of the polypeptide shown in table II, application no. 19, columns 5 and 7 and conferring an increase in the amount of the fine chemical according to table IIB, application no. 19, column 6 in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a)

to (h) or of the nucleic acid molecule shown in table I, application no. 19, columns 5 and 7 or a nucleic acid molecule encoding, preferably at least the mature form of, the polypeptide shown in table II, application no. 19, columns 5 and 7, and conferring an increase in the amount of the fine chemical according to table IIB, application no. 19, column 6 in an organism or a part thereof; or which encompasses a sequence which is complementary thereto; whereby, preferably, the nucleic acid molecule according to (a) to (l) distinguishes over the sequence depicted in table IA and/or IB, application no. 19, columns 5 and 7 by one or more nucleotides. In one embodiment, the nucleic acid molecule of the invention does not consist of the sequence shown in table IA and/or IB, application no. 19, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 18, columns 5 and 7. In a further embodiment the nucleic acid molecule does not encode the polypeptide sequence shown in table IIA and/or IIB, application no. 19, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 19, columns 5 and 7 does not encode a protein of the sequence shown in table IIA and/or IIB, application no. 19, columns 5 and 7. Accordingly, in one embodiment, the protein encoded by a sequence of a nucleic acid according to (a) to (l) does not consist of the sequence shown in table IA and/or IB, application no. 19, columns 5 and 7. In a further embodiment, the protein of the present invention is at least 30% identical to protein sequence depicted in table IIA and/or IIB, application no. 19, columns 5 and 7 and less than 100%, preferably less than 99.999%, 99.99% or 99.9%, more preferably less than 99%, 985, 97%, 96% or 95% identical to the sequence shown in table IIA and/or IIB, application no. 19, columns 5 and 7.

for the disclosure of the paragraphs [0217.0.0.18] to [0226.0.0.18] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446451. The vectors are preferably modified in such a manner, that they already contain the nucleic acid coding for the transitpeptide and that the nuleic acids of the invention, preferentially the nucleic acid sequences encoding the polypeptides shown in table II, application no. 19, columns 5 and 7 can be cloned 3' prime to the transitpeptide encoding sequence, leading to a functional preprotein, which is directed to the plastids and which means that the mature protein fulfills its biological activity.

for the disclosure of the paragraphs [0228.0.0.18] to see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 19, columns 5 and 7 or its derivatives, it is advantageous additionally to express and/or mutate further genes in the organisms. It can be especially advantageously, if additionally at least one further gene of the sinapic acid or ferulic acid biosynthetic pathway, e.g. of the phenylpropanoid pathway, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the sequences shown in Table I, application no. 19, columns 5 and 7 with genes which generally support or enhances the growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the phenylpropanoid metabolism. Indirect overexpression might be achieved by the manipulation of the regulation of the endogenous gene, for example through promotor mutations or the expression of natural or artificial transcriptional regulators.

Further advantageous nucleic acid sequences which can be expressed in combination with the sequences used in the process and/or the abovementioned biosynthesis genes are the sequences encoding further genes of the phenylpropanoid pathway like cinnamate-4-hydroxylase (C4H), chalcone synthase (CHS), Ferulate 5-hydroxylase (F5H) or phenylalanine ammonia-lyase (PAL). These genes may lead to an increased synthesis of sinapic acid or ferulic acid.

In a further advantageous embodiment of the process of the invention, the organisms used in the process are those in which simultaneously a sinapic acid or ferulic acid degrading protein is attenuated, in particular by reducing the rate of expression of the corresponding gene.

The respective fine chemical produced can be isolated from the organism by methods with which the skilled worker is familiar. For example, via extraction, salt precipitation, and/or different chromatography methods. The process according to the invention can be conducted batchwise, semibatchwise or continuously. The respective fine chemical produced by this process can be obtained by harvesting the organisms, either from the crop in which they grow, or from the field. This can be done via pressing or extraction of the plant parts.

for the disclosure of the paragraphs [0243.0.0.18] to [0264.0.0.18] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastidtransit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 19, columns 5 and 7 and described herein to achieve an expression in one of said compartments or extracellular.

for the disclosure of the paragraphs [0266.0.0.18] to [0287.0.0.18] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 19, columns 5 and 7 or their homologs is functionally linked to a plastidial targeting sequence. A further preferred embodiment of the invention relates to a vector in which a nucleic acid sequence encoding one of the polypeptides shown in table II, application no. 19, columns 5 and 7 or their homologs is functionally linked to a regulatory sequences which permit the expression in plastids.

for the disclosure of the paragraphs [0289.0.0.18] to [0296.0.0.18] see paragraphs [0289.0.0.0] to [0296.0.0.0] above.

Moreover, a native polypeptide conferring the increase of the respective fine chemical in an organism or part thereof can be isolated from cells (e.g., endothelial cells), for example using the antibody of the present invention as described herein, in particular, an antibody against polypeptides as shown in table II, application no. 19, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 19, columns 5 and 7 or as coded by the nucleic acid molecule shown in table I, application no. 19, columns 5 and 7 or functional homologues thereof.

In one advantageous embodiment, in the method of the present invention the activity of a polypeptide is increased comprising or consisting of the consensus sequence shown in table IV, application no. 19, columns 7 and in one another embodiment, the present invention relates to a polypeptide comprising or consisting of the consensus sequence shown in table IV, application no. 19, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.18] to [0304.0.0.18] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 19, columns 5 and 7 by one or more amino acids. In one embodiment, polypeptide distinguishes form the sequence shown in table IIA and/or IIB, application no. 19, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 19, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 19, columns 5 and 7.

for the disclosure of this paragraph see paragraph [0306.0.0.0] above.

In one embodiment, the invention relates to polypeptide conferring an increase of level of the respective fine chemical indicated in Table IIA and/or IIB, application no. 19, column 6 in an organism or part being encoded by the nucleic acid molecule of the invention or used in the process of the invention and having a sequence which distinguishes from the sequence as shown in table IIA and/or IIB, application no. 19, columns 5 and 7 by one or more amino acids. In another embodiment, said polypeptide of the invention does not consist of the sequence shown in table IIA and/or IIB, application no. 19, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 19, columns 5 and 7.

In one embodiment, the present invention relates to a polypeptide having the activity of the protein as shown in table IIA and/or IIB, application no. 19, column 3, which distinguishes over the sequence depicted in table IIA and/or IIB, application no. 19, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle, for example into the plastid or mitochondria.

for the disclosure of the paragraphs [0309.0.0.18] to [0311.0.0.18] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 19, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 19, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 19, columns 5 and 7 or which is homologous thereto, as defined above.

Accordingly the polypeptide of the present invention can vary from the sequences shown in table IIA and/or IIB, application no. 19, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 19, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 19, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 19, column 3. Differences shall mean at least one amino acid different from the sequences as shown in table II, application no. 19, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 19, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 19, column 3. The nucleic acid molecules and polypeptide molecules of the invention are expressed such that the yield, production, and/or efficiency of production of a desired compound is improved.

Preferably, the compound is a composition comprising the essentially pure fine chemical, i.e. sinapic acid or ferulic acid or a recovered or isolated sinapic acid or ferulic acid in free or bound form.

for the disclosure of the paragraphs [0320.0.0.18] to [0322.0.0.18] see paragraphs [0320.0.0.0] to [0322.0.0.0] above.

In one embodiment, a protein (=polypeptide) as shown in table II, application no. 19, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 19, column 3, e.g., a protein which does not confer the activity described herein and which is derived from the same or a different organism.

for the disclosure of the paragraphs [0324.0.0.18] to [0329.0.0.18] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 19, columns 5 and 7.

for the disclosure of the paragraphs [0331.0.0.18] to [0346.0.0.18] see paragraphs [0331.0.0.0] to [0346.0.0.0] above.

Accordingly the present invention relates to any cell transgenic for any nucleic acid characterized as part of the invention, e.g. conferring the increase of the respective fine chemical indicated in column 6 of application no. 19 in any one of Talbes I to IV in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 19, column 3. Due to the above mentioned activity the respective fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 19, column 3 or a protein as shown in table II, application no. 19, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 19, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.18] to [0358.0.0.18] see paragraphs [0350.0.0.0] to [0358.0.0.0] above.

Transgenic plants comprising the respective fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The respective fine chemical indicated in column 6 of any one of Tables I to IV, application no. 19 and being produced in the process according to the invention may, however, also be isolated from the plant as one of the above mentioned derivates of sinapic acid or ferulic acid itself and can be isolated by harvesting the plants either from the culture in which they grow or from the field. This can be done for example via pressing out, grinding and/or extraction of the plant parts, preferably the plant seeds, plant fruits, plant tubers and the like.

for the disclosure of the paragraphs [0360.0.0.18] to [0362.0.0.18] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the respective fine chemical produced in the process can be isolated. The resulting composition or fraction comprising the respective fine chemical can, if appropriate, subsequently be further purified, if desired mixed with other active ingredients such as fatty acids, vitamins, amino acids, carbohydrates, antibiotics, covitamins, antioxidants, carotenoids, and the like, and, if appropriate, formulated.

In one embodiment, the composition is the fine chemical.

The fine chemical indicated in column 6 of application no. 19 in Table I, and being obtained in the process of the invention are suitable as starting material for the synthesis of further products of value. For example, they can be used in combination with each other or alone for the production of pharmaceuticals, foodstuffs, animal feeds or cosmetics. Accordingly, the present invention relates a method for the production of pharmaceuticals, food stuff, animal feeds, nutrients or cosmetics comprising the steps of the process according to the invention, including the isolation of a composition comprising the fine chemical, e.g. sinapic acid or ferulic acid or the isolated respective fine chemical produced, if desired, and formulating the product with a pharmaceutical acceptable carrier or formulating the product in a form acceptable for an application in agriculture. A further embodiment according to the invention is the use of the respective fine chemical indicated in application no. 19, Table I, column 6, and being produced in the process or the use of the transgenic organisms in animal feeds, foodstuffs, medicines, food supplements, cosmetics or pharmaceuticals.

for the disclosure of the paragraphs
see paragraphs [0366.0.0.0] to [0369.0.0.0] above.

The fermentation broths obtained in this way, containing in particular the respective fine chemical indicated in column 6 of any one of Tables I to IV; application no. 19 or containing mixtures with other compounds, in particular with other phenolic acids, normally have a dry matter content of from 7.5 to 25% by weight. The fermentation broth can be processed further. Depending on requirements, the biomass can be separated, such as, for example, by centrifugation, filtration, decantation, coagulation/flocculation or a combination of these methods, from the fermentation broth or left completely in it. The fermentation broth can be thickened or concentrated by known methods, such as, for example, with the aid of a rotary evaporator, thin-film evaporator, falling film evaporator, by reverse osmosis or by nanofiltration. This concentrated fermentation broth can then be worked up by extraction, freeze-drying, spray drying, spray granulation or by other processes.

A wide range of advantageous methods and techniques for the isolation of sinapic acid or ferulic acid can be found in the state of the art. Accordingly, it is possible to further purify the produced sinapic acid or ferulic acid. For this purpose, the product-containing composition, e.g. a total or partial lipid extraction fraction using organic solvents, e.g. as described above, is subjected for example to a saponification to remove triglycerides, partition between e.g. hexane/methanol (separation of non-polar epiphase from more polar hypophasic derivates) and separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.18] to [0376.0.0.18], [0376.1.0.18] and [0377.0.0.18] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting-, e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 19, columns 5 and 7, preferably in table IB, application no. 19, columns 5 and 7, and, optionally, isolating the full length cDNA clone or complete genomic clone;

(c) introducing the candidate nucleic acid molecules in host cells, preferably in a plant cell or a microorganism, appropriate for producing the respective fine chemical;

(d) expressing the identified nucleic acid molecules in the host cells;

(e) assaying the respective fine chemical level in the host cells; and (f) identifying the nucleic acid molecule and its gene product which expression confers an increase in the respective fine chemical as indicated for application no. 19 in any one of Tables I to IV level in the host cell after expression compared to the wild type.

for the disclosure of the paragraphs [0379.0.0.18] to [0383.0.0.18] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 19, column 3, e.g. comparing near identical organisms with low and high activity of the proteins as shown in table II, application no. 19, column 3.

for the disclosure of the paragraphs [0385.0.0.18] to [0404.0.0.18] see paragraphs [0385.0.0.0] to [0404.0.0.0] above.

Accordingly, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical indicated in Column 6, Table I, application no. 19 or for the production of the respective fine chemical and one or more other carotenoids, vitamins or fatty acids. In one embodiment, in the process of the present invention, the produced sinapic acid or ferulic acid is used to protect fatty acids against oxidation, e.g. it is in a further step added in a pure form or only partly isolated to a composition comprising fatty acids.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the respective fine chemical in a organism or part thereof, e.g. in a cell.

The nucleic acid molecule of the invention, the vector of the invention or the nucleic acid construct of the invention may also be useful for the production of organisms resistant to inhibitors of the sinapic acid or ferulic acid production biosynthesis pathways. In particular, the overexpression of the polypeptide of the present invention may protect an organism such as a microorganism or a plant against inhibitors, which block the sinapic acid or ferulic acid biosynthesis, in particular the respective fine chemical synthesis in said organism.

As sinapic acid or ferulic acid can protect organisms against damages of oxidative stress, especially singlet oxygens, a increased level of the respective fine chemical can protect plants against herbicides which cause the toxic buildup of oxidative compounds, e.g. singlet oxygens. For example, inhibition of the protoporphorineogen oxidase (Protox), an enzyme important in the synthesis of chlorophyll and heme biosynthesis results in the loss of chlorophyll and carotenoids and in leaky membranes; the membrane destruction is due to creation of free oxygen radicals (which is also reported for other classic photosynthetic inhibitor herbicides).

Accordingly, in one embodiment, the increase of the level of the respective fine chemical is used to protect plants against herbicides destroying membranes due to the creation of free oxygen radicals.

Examples of inhibitors or herbicides building up oxidative stress are aryl triazion, e.g. sulfentrazone, carfentrazone; or diphenylethers, e.g. acifluorfen, lactofen, or oxyfluorfen; or N-Phenylphthalimide, e.g. flumiclorac or flumioxazin; substituted ureas, e.g. fluometuron, tebuthiuron, diuron, or linuron; triazines, e.g. atrazine, prometryn, ametryn, metributzin, prometon, simazine, or hexazinone: or uracils, e.g. bromacil or terbacil.

In a further embodiment the present invention relates to the use of the antagonist of the present invention, the plant of the present invention or a part thereof, the microorganism or the host cell of the present invention or a part thereof for the production a cosmetic composition or a pharmaceutical composition. Such a composition has an antioxidative activity, photoprotective activity, can be used to protect, treat or heal the above mentioned diseases, e.g. hypercholesterolemic or cardiovascular diseases, certain cancers, and cataract formation or can be used as an immunostimulatory agent.

Sinapic acid or ferulic acid can be also used as stabilizer of other colours or oxygen sensitive compounds, like fatty acids, in particular unsaturated fatty acids.

for the disclosure of the paragraphs [0406.0.0.18] to [0416.0.0.18] see paragraphs [0406.0.0.0] to [0416.0.0.0] above.

An in vivo mutagenesis of organisms such as algae (e.g. *Spongiococcum* sp, e.g. *Spongiococcum exentricum, Chlorella* sp., *Haematococcus, Phaedactylum tricornatum, Volvox* or *Dunaliella*), *Synechocystis* sp. PCC 6803, *Physcometrella patens, Saccharomyces, Mortierella, Escherichia* and others mentioned above, which are beneficial for the production of sinapic acid or ferulic acid can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widely used as chemical agents for random in-vitro mutagensis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired fine chemical.

for the disclosure of the paragraphs [0418.0.0.18] to [0427.0.0.18] see paragraphs [0418.0.0.0] to [0427.0.0.0] above.

for the disclosure of the paragraphs [0427.1.9.18] see paragraphs [0428.1.9.9] above for the disclosure of the paragraphs [0427.2.9.18] see paragraph [0428.2.9.9] above.

for the disclosure of the paragraphs [0427.3.9.18] see paragraph [0428.3.9.9] above.

Sinapic acid or ferulic acid may be produced in *Synechocystis* spec. PCC 6803

The cells of each of independent *Synechocystis* spec. PCC 6803 strains cultured on the BG-11 km agar medium, and untransformed wild-type cells (on BG11 agar medium without kanamycin) can be used to inoculate liquid cultures. For this, cells of a mutant or of the wild-type *Synechocystis* spec. PCC 6803 are transferred from plate into 10 ml of liquid culture in each case. These cultures are cultivated at 28° C. and 30 pmol photons*$(m^2 \cdot s)^{-1}$ (30 µE) for about 3 days. After determination of the $OD_{730}$ of the individual cultures, the $OD_{730}$ of all cultures is synchronized by appropriate dilutions with BG-11 (wild types) or e.g. BG-11 km (mutants). These cell density-synchronized cultures are used to inoculate three cultures of the mutant and of the wild-type control. It is thus possible to carry out biochemical analyses using in each case three independently grown culutres of a mutant and of the corresponding wild types. The cultures are grown until the optical density was $OD_{730}=0.3$.

The cell culture medium is removed by centrifugation in an Eppendorf bench centrifuge at 14000 rpm twice. The subsequent disruption of the cells and extraction sinapic acid or ferulic acid take place by incubation in an Eppendorf shaker at 30° C., 1000 rpm in 100% methanol for 15 minutes twice, combining the supernatants obtained in each case.

In order to avoid oxidation, the resulting extracts can be analyzed immediate after the extraction with the aid of a Waters Allience 2690 HPLC system. Sinapic acid or ferulic acid can be separated on a reverse phase column and identified by means of a standard. The fluorescence of the substances which can be detected with the aid of a Jasco FP 920 fluorescence detector, can serve as detection system.

for the disclosure of the paragraphs [0428.0.0.18] to [0436.0.0.18] see paragraphs [0428.0.0.0] to [0436.0.0.0] above.

for the disclosure of the paragraphs [0437.0.0.18] and [0438.0.0.18] see paragraphs [0437.0.0.0] and [0438.0.0.0] above.

Example 8

Analysis of the Effect of the Nucleic Acid Molecule on the Production of the Respective Fine Chemical Indicated in Table I, Application No. 19, Column 6

The effect of the genetic modification in plants, fungi, algae, ciliates or on the production of a desired compound (such as a ferulic acid or sinapic acid) can be determined by growing the modified microorganisms or the modified plant under suitable conditions (such as those described above) and analyzing the medium and/or the cellular components for the elevated production of desired product (i.e. of ferulic acid or sinapic acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications).

Alternatively ferulic acid can be detected as described in Mattila, P. and Kumpulainen J., J. Agric Food Chem. 2002 Jun. 19; 50(13):3660-7.

Alternatively sinapic acid can be detected as described in Noda, M. and Matsumoto, M., Biochim Biophys Acta. 1971 Feb. 2; 231(1):131-3.

for the disclosure of this paragraph see [0441.0.0.0] above.

Example 9

Purification of the Ferulic Acid or Sinapic Acid

Abbreviations; GC-MS, gas liquid chromatography/mass spectrometry; TLC, thin-layer chromatography.

The unambiguous detection for the presence of ferulic acid or sinapic acid can be obtained by analyzing recombinant organisms using analytical standard methods: LC, LC-MSMS or TLC, as described. The total amount produced in the organism for example in yeasts used in the inventive process can be analysed for example according to the following procedure:

The material such as yeasts, *E. coli* or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, separation of non-polar epiphase from more polar hypophasic derivatives and chromatography.

For analysis, solvent delivery and aliquot removal can be accomplished with a robotic system comprising a single injector valve Gilson 232XL and a 4022S1V diluter [Gilson, Inc. USA, 3000 W. Beltline Highway, Middleton, Wis.]. For saponification, 3 ml of 50% potassium hydroxide hydro-ethanolic solution (4 water-1 ethanol) can be added to each vial, followed by the addition of 3 ml of octanol. The saponification treatment can be conducted at room temperature with vials maintained on an IKA HS 501 horizontal shaker [Lab-world-online, Inc., Wilmington, N.C.] for fifteen hours at 250 movements/minute, followed by a stationary phase of approximately one hour.

Following saponification, the supernatant can be diluted with 0.17 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol: 4 water: 15 tetrahydrofuran (THF) stabilized with 0.2% BHT (2,6-di-tert-butyl-4-methylphenol). Injections were 20 µl. Separation can be isocratic at 30° C. with a flow rate of 1.7 ml/minute. The peak responses can be measured by absorbance at 447 nm.

Alternatively ferulic acid can be detected as described in Mattila, P. and Kumpulainen J., J. Agric Food Chem. 2002 Jun. 19; 50(13):3660-7.

Alternatively sinapic acid can be detected as described in Noda, M. and Matsumoto, M., Biochim Biophys Acta. 1971 Feb. 2; 231(1):131-3.

Characterization of the Transgenic Plants

In order to confirm that sinapic acid or ferulic acid biosynthesis in the transgenic plants is influenced by the expression of the polypeptides described herein, the sinapic acid or ferulic acid content in leaves, seeds and/or preferably flowers of the plants transformed with the described constructs (*Arabidopsis thaliana*, *Brassica napus* and *Nicotiana tabacum*) is analyzed. For this purpose, the transgenic plants are grown in a greenhouse, and plants which express the gene coding for polypeptide of the invention or used in the method of the invention are identified at the Northern level. The sinapic acid or ferulic acid content in flowers, leaves or seeds of these plants is measured. In all, the sinapic acid or ferulic acid concentration is raised by comparison with untransformed plants.

If required and desired, further chromatography steps with a suitable resin may follow. Advantageously, the sinapic acid or ferulic acid can be further purified with a so-called RTH-PLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

for the disclosure of the paragraphs [0446.0.0.18] to [0496.0.0.18] see paragraphs [0446.0.0.0] to [0496.0.0.0] above.

As an alternative, the sinapic acid or ferulic acid can be detected advantageously as described above.

The results of the different plant analyses can be seen from the table, which follows:

TABLE VI

| ORF | Metabolite | Method/Analytics | Min.-Value | Max.-Value |
|---|---|---|---|---|
| b0931 | Sinapic acid | GC | 1.29 | 1.97 |
| b1556 | Sinapic acid | GC | 1.40 | 1.88 |
| b1797 | Sinapic acid | GC | 1.29 | 1.36 |
| YDR03W | Ferulic acid | LC | 1.37 | 1.75 | for the disclosure of the paragraphs [0499.0.0.18] and [0500.0.0.18] see paragraphs [0499.0.0.0] and [0500.0.0.0] above.

Example 15a

Engineering Ryegrass Plants by Over-Expressing b0931 from *E. coli* or Homologs of b0931 from Other Organisms for the disclosure of the paragraphs [0502.0.0.18] to [0508.0.0.18] see paragraphs [0502.0.0.0] to [0508.0.0.0] above.

Example 15b

Engineering Soybean Plants by Over-Expressing b0931 from *E. coli* or Homologs of b0931 from Other Organisms for the disclosure of the paragraphs [0510.0.0.18] to [0513.0.0.18] see paragraphs [0510.0.0.0] to [0513.0.0.0] above.

Example 15c

Engineering Corn Plants by Over-Expressing b0931 from *E. coli* or Homologs of b0931 from Other Organisms for the disclosure of the paragraphs [0515.0.0.18] to [0540.0.0.18] see paragraphs [0515.0.0.0] to [0540.0.0.0] above.

Example 15d

Engineering Wheat Plants by Over-Expressing b0931 from *E. coli* or Homologs of b0931 from Other Organisms for the disclosure of the paragraphs [0542.0.0.18] to [0544.0.0.18] see paragraphs [0542.0.0.0] to [0544.0.0.0] above.

Example 15e

**Engineering Rapeseed/Canola Plants by Over-Expressing b0931 from *E. coli* or Homologs of b0931 from Other Organisms** for the disclosure of the paragraphs [0546.0.0.18] to [0549.0.0.18] see paragraphs [0544.0.0.0] to [0549.0.0.0] above.

Example 15f

**Engineering Alfalfa Plants by Over-Expressing b0931 from *E. coli* or Homologs of b0931 from Other Organisms** for the disclosure of the paragraphs [0551.0.0.18] to [0554.0.0.18] see paragraphs [0551.0.0.0] to [0554.0.0.0] above.

./.
for the disclosure of this paragraph see [0554.2.0.0] above.
for the disclosure of this paragraph see [0555.0.0.0] above.
for the disclosure of this paragraph see [0001.0.0.0].

Carbohydrates are aldehyde or ketone compounds with multiple hydroxyl groups. Many carbohydrates have the empirical formula $(CH_2O)_n$; some also contain nitrogen, phosphorus, or sulfur.

Carbohydrates are classsfied in monosaccharides, oligosaccharides, and polysaccharides. Monosaccharides, or simple sugars, consist of a single polyhydroxy aldehyde or ketone unit. Monosaccharides of more than four carbons tend to have cyclic structures.

Oligosaccharides consist of short chains of monosaccharide units, or residues, usually 2 to 19 units, joined by glycosidic bonds.

The polysaccharides are sugar polymers containing more than 20 or so monosaccharide units, and some have hundreds or thousands of units. Some polysaccharides are linear chains; others are branched.

Carbohydrates are called saccharides or, if they are relatively small, sugars.

In the present invention, saccharides means all of the aforementioned carbohydrate, e.g. monosaccharides, preferably fructose, glucose, inositol, galactose, arabinose, xylose or other pentoses or hexoses; oligosaccharides, preferably disaccharides like sucrose, lactose or trisaccharides like raffinose; or polysaccharides like starch or cellulose.

Carbohydrates are the most abundant class of organic compounds found in living organisms.

They are a major source of metabolic energy, both for plants and for animals. Aside from the sugars and starches that meet this vital nutritional role, carbohydrates function in energy storage (for example starch or glycogen), in signaling (by glycoproteins and glycolipids, e.g. blood group determinants), fuel the nervous system, muscle and virtually all cells, are parts of nucleic acids (in genes, mRNA, tRNA, ribosomes), and as cell surface markers as recognition sites on cell surfaces and signaling in glycolipids and glycoproteins and also serve as a structural material for example as cell wall components (cellulose).

Glucose, also called dextrose, is the most widely distributed sugar in the plant and animal kingdoms and it is the sugar present in blood as "blood sugar". It occupies a central position in the metabolism of plants, animals, and many microorganism. Glucose is rich in potential energy, and thus a good fuel; in the body is catabolised to produce ATP. It is stored as a high molecular weight polymer such as starch or glycogen or is converted to fatty acids. It is also a remarkably versatile precursor, capable of supplying a huge array of metabolic intermediates for biosynthetic reactions.

Based on its manifold features, glucose is used in nutrition and medicine.

Fructose, also called levulose or "fruit sugar", is the most important ketose sugar. Fructose is a hexose and is a reducing sugar. Fructose is used a sweetener by diabetics because it does not rise the blood sugar level, even in large amounts.

Fructose and glucose are the main carbohydrate constituents of honey. Those hexoses are further the main components of many oligo- and polysaccharides, like sucrose, raffinose, stachyose, trehalose, starch, cellulose or dextran.

The most frequent disaccharide is sucrose (saccharose, beta-D-fructofuranosyl-alphaD-glucopyranosid, cane sugar, beet sugar, sugar in a narrow sense of a name for commercially available sucrose meaning sucrose is the sugar that is commonly called "sugar") which consists of the six-carbon sugars D-glucose and D-fructose. It is formed by plants but not by animals. Sucrose is a major intermediate product of photosynthesis; in many plants it is the principal form in which sugar is transported from the leaves to other parts of the plant body. In mammalians sucrose is an obligatory component of blood and its content in blood is kept at the stable level. It is strongly necessary for brain cells as well as for normal functioning of the central nervous system. Sugar is widely-known as a source of glycogen—a substance, feeding liver, heart and muscles. It is one of the most widely-used food products and is the major disaccharide in most diets. It is present in honey, maple sugar, fruits, berries, and vegetables. It may be added to food products as liquid or crystalline sucrose or as invert sugar. It is commercially prepared from sugar cane or sugar beets. Sucrose can provide a number of desirable functional qualities to food products including sweetness, mouth-feel, and the ability to transform between amorphous and crystalline states. High-concentrated sucrose is a natural preserving agent, it determines gel-formation processes, gives necessary viscosity to the products. Sucrose is a raw material for caramel, colour etc. Sucrose is further an excellent fermentation feedstock, which is of specific interest for fermentation industry (including a number of non-food industries -pharmaceutical industries). The presence of eight hydroxyl groups in the sucrose molecule provides a theoretical possibility of a very large number of sucrose derivatives. Sucrose derivatives are used by industries in production of detergents, emulsifiers (sucrose+fatty acids) and adhesives (sucrose octa acetate).

Sucrose is a precursor to a group of carbohydrates in plants known as the raffinose family of oligosaccharides found in many plant seeds especially legumes. This family contains the trisaccharide raffinose, the tetrasaccharide stachyose and the pentasaccharide verbascose. Oligosaccharides of the raffinose-series are major components in many food legumes (Shallenberger et al., J. Agric. Food Chem., 9, 1372; 1961). Raffinose (beta-D-fructofuranosyl-6-O-alpha-D-galactopyranosyl-alpha-D-glucopyranosid, melitriose, gossypose, melitose), which consists of sucrose with a-galactose attached through its C4 atom to the 1 position on the fructose residue and is thought to be second only to sucrose among the nonstructural carbohydrates with respect to abundance in the plant kingdom. It may be ubiquitous, at least among higher plants. Raffinose accumulate in significant quantities in the edible portion of many economically significant crop species. Examples include soybean, sugar beet, cotton, canola and all of the major edible leguminous crops including beans, peas, lentil and lupine.

An important key intermediates in the formation of raffinose and stachyose is myoinositol (cyclohexan-1,2,3,4,5,6-hexaole), the most common cyclitol. Myo-inositol is fundamental to many different aspects of plant growth and development. In addition to its role as the precursor for phytic acid biosynthesis, myo-inositol is also used for uronide and pentose biosynthesis, it is also present in phosphoinositides of plant cell membranes, as well as other complex plant lipids including glycophosphoceramides. Furthermore, it is also a precursor of other naturally occurring inositol isomers, and many of these as well as myo-inositol are distributed as methyl ethers in a species specific pattern throughout the plant kingdom. Myo-inositol is an important growth factor.

The most carbohydrates found in nature occur as polysaccharides which are polymers of medium to high molecular weight. Polysaccharides, also called glycans, differ from each other in the identity of their recurring monosaccharide units, in the length of their chains, in the types of bonds linking the units, and in the degree of branching.

Starch is the most valuable polysaccharide. Normal native starches consist of a mixture of 15-30% amylose and 70-85% amylopectin. Amylose structurally is a linear polymer of anhydroglucose units, of molecular weight approximately between 40 000 and 340 000, the chains containing 250 to 2000 anhydroglucose units. Amylopectin is considered to be composed of anhydroglucose chains with many branch points; the molecular weight may reach as high as 80 000 000.

Starch is the most important, abundant, digestible food polysaccharide. It occurs as the reserve polysaccharide in the leaf, stem, root, seed, fruit and pollen of many higher plants. It occurs as discrete, partially-crystalline granules whose size, shape, and gelatinization temperature depend on the botanical source of the starch. Common food starches are derived from seed (wheat, maize, rice, barley) and root (potato, cassava/tapioca) sources. Starches have been modified to improve desired functional characteristics and are added in relatively small amounts to foods as food additives. Another important polysaccharide is cellulose. Cellulose is the most commonly seen polysaccharide and scientist estimate that over one trillion tons of cellulose are synthesized by plants each year. Cellulose forms the cell wall of plants. It is yet a third polymer of the monosaccharide glucose. Cellulose differs from starch and glycogen because the glucose units form a two-dimensional structure, with hydrogen bonds holding together nearby polymers, thus giving the molecule added stability. A single "cellulose fiber" can consist of up to 10000 individual anhydroglucose units. In cellulose, the individual fiber molecules are arranged in bundles and thus form so called micro fibrils which ultimately result in a "densely woven" net like structure of cellulose molecules. The strong cohesion between the individual cellulose fibers is due to the huge number of strong hydrogen bonds.

Cellulose is the major polysaccharide of grass, leaves and trees and is said to include around 50% of all biological carbon found on our planet. It is the basic material of natural substances such as wood, flax or cotton and consists of long, unbranched fiber molecules. Cellulose, as plant fiber, cannot be digested by human beings therefore cellulose passes through the digestive tract without being absorbed into the body. Some animals, such as cows and termites, contain bacteria in their digestive tract that help them to digest cellulose. Nevertheless, cellulose is of importance in human nutrition in that fiber is an essential part of the diet, giving bulk to food and promoting intestinal motility.

The polysaccharides starch and cellulose are the most important raw material in the industrial and commercial production of glucose. In the common procedure starch or cellulose are acidly or enzymatically hydrolysed to glucose. Many crops can be used as the source of starch Maize, rice, wheat, potato, cassava, arrowroot, and sago are all used in various parts of the world. In the United States, cornstarch is used almost exclusively.

The enzymatic process has two main steps. A first step in which the starch is heated for 1-2 hours up to approximately 100° C. During this the starch is hydrolyzed into smaller carbohydrates containing on average 5-10 glucose units each. Some variations on this process briefly heat the starch mixture to 130° C. or hotter one or more times. This heat treatment improves the solubility of starch in water, but deactivates the enzyme, and fresh enzyme must be added to the mixture after each heating.

In the second step the partially hydrolyzed starch is completely hydrolyzed to glucose by using a glucoamylase. The resulting glucose solution is further purified by filtration and concentrated in a multiple-effect evaporator. The endproduct of the process is solid D-glucose, which is a starting material for the synthesis of fructose.

In the body glucose can be converted to UDP glucose, which is an intermediate for the cell wall synthesis and other interacting pathways such as sucrose, starch and glycogen biosynthesis.

Fructose commonly known as fruit sugar, fructose is a simple carbohydrate widely distributed in organism, plants, and animals. Fructose is often recommended for, and consumed by, people with diabetes mellitus or hypoglycemia, because it has a very low Glycemic Index relative to sucrose. Fructose is usually produced from starch by enzymatically transforming it into glucose syrup and subsequently treating with an isomerase, leading to a conversion of glucose to fructose.

Sucrose—commonly referred to as table sugar—is a disaccharide comprising glucose and fructose. Sucrose is obtained commercially from the expressed juice of sugar cane or of sugar beet. The refining process removes impurities from the sugar plant, producing white sugar crystals.

Myo-inositol exists in nature either in its free form (found, for example, in sugarcane, beet molasses, and almond hulls) or as a hexaphosphate called phytin (found, for example, in corn steep liquor). Industrial purification of phytin from corn steep liquor involves precipitation with calcium, followed by hydrolysis with a strong acid. Separation of free form inositols from plant extracts involves treatment with acid and separation of myo-inositol by column (U.S. Pat. No. 5,482, 631) or the use of ion-exchange (U.S. Pat. No. 4,482,761).

Myo-inositol, the major nutritionally active form of inositol, is vital to many biological processes of the body, participating in a diverse range of activities. Myo-inositol is one of nine distinct isomers of inositol. It is for example essential for the growth of rodents, but not for most other animals, including humans. Humans can make myo-inositol endogenously, which they do from glucose. Nevertheless myo-inositol influences certain biological activities inside the body. It may affect behavior and may have antidepressant and anti-anxiety activities. It is synthesized in general from phytin.

Myo-inositol is metabolized to phosphatidylinositol a small but important component of cell membranes. Phosphatidylinositol can be further converted to phosphatidylinositol-4,5-bisphosphate, which is a key intermediate in biological signaling. Phosphatidylinositol-4,5-bisphosphate is the precursor of at least three second-messenger molecules, which are as follows: a) inositol-1,4,5-triphosphate, diacylglycerol, and phosphatidylinositol-3,4,5-triphosphate, which is involved in signal transduction. Inositol-1,4,5triphosphate is a modifier of the intracellular calcium level. Diacylglycerol regulates some members of the protein kinase C family.

The various forms of inositol (e.g. phosphatidylinositol or inositides such as 1,4,5inositoltriphosphate=IP3) are active in cell-to-cell communication, including the transmission of nerve impulses. Tissues that are affected include the brain, liver and muscles. Inositol is an indirect source of glucose and glucoronic acid, which is essential to detoxification by the liver.

Cellulose is a very important industrial product. As disclosed above, it serves as row material for monosaccharides. It is further used in the manufacture of paper, textiles, plastics, explosives, packaging material (Cellophane®), feed, food and fermentation products. Cellulose is obtained primarily by acid or alkaline hydrolize.

Oxidized cellulose leads to anhydroglucose in the polymer chain of cellulose. It is an inherently non-homogeneous natural raw material, which when selectively, yet not exclusively, oxidised on the C6 carbon atom will yield oxidised product also containing byproducts formed by other oxidation routes.

Starch is a polymer of anhydroglucose units linked by alpha-1,4 linkages. It is one of the most abundant renewable polymers found in nature. Starch occurs intracellularly as large clusters or granules. These granular starch consists of microscopic-granules, which differ in size and shape, depending on the plant source. The granules are insoluble in water at room temperature. There is a quite number of methods known for the extraction of starch. For example a slurry of grinded starch containing plant material is heated, whereby the granules swell and eventually burst, dispersing the starch molecules into the solution. During the liquefaction step, the long-chained starch is further degraded into smaller branched and linear units (maltodextrins) by an alpha-amylase. A large number of processes have been described for converting starch to starch hydrolysates, such as maltose, glucose or specialty syrups, either for use as sweeteners or as precursors for other saccharides such as fructose. A process for enzymatic hydrolysis of granular starch into a soluble starch hydrolysate is disclosed in US 20050042737.

Carbohydrates play a major role in human and animal diets, comprising some 40-75% of energy intake. Their most important nutritional property is digestibility. Some of them are hydrolyzed by enzymes of the human gastrointestinal system to monosaccharides that are absorbed in the small intestine and enter the pathways of carbohydrate metabolism. Others can be digested by certain animals.

Carbohydrates, fat and protein are the energy yielding nutrients in animal feed. In the average diet for farm animals, carbohydrates are included at levels of 70-80%. For example pig diets are mainly based on cereals which contain the main part of the energy providing nutrients that are essential for pigs.

With view to the increasing global demand for food because of the growing world population and at the same time the shrinking availability of arable land, it is important to increase the food and feed quality, particularly the availability of certain essential nutrients, preferably carbohydrates, preferably polysaccharides like starch or cellulose and/or monosaccharides like fructose, glucose and/or myo-inositol and/or trisaccharides like raffinose and/or disaccharides like sucrose. Nutritional improvements in foods and feeds could help to meet these demands for improved quality. Modern agricultural biotechnology, which involves the application of cellular and molecular techniques to transfer DNA that encodes a desired trait to food and feed crops, is a powerful complement to traditional methods to meet global food and feed requirements.

Furthermore the physicochemical properties such as viscosity and the capacity to bind water and ions, vary between different cereals. Consequently, different cereal properties affect digestion and fermentation as well as microbial populations in the gastrointestinal tract in various ways. Gastrointestinal disturbances comprise a major problem for health of humans and animals.

There is a need for suitable dietary composition and food or feed ingredients, preferably cereals, legumes or fruits which promotes a beneficial gut environment and thereby preventing gastrointestinal disorders.

Therefore improving the quality of foodstuffs and animal feeds is an important task of the food-and-feed industry. This is necessary since, for example, carbohydrates, which occur in plants and some microorganisms are limited with regard to the supply of mammals. Especially advantageous for the quality of foodstuffs and animal feeds is as balanced as possible a carbohydrate profile in the diet since a great excess of some sugars above a specific concentration in the food has only some or little or no positive effect.

Genetically modified plants having improved nutritional profiles are known in the state of art. US 20030070192 discloses a DNA expression cassette which alters the sugar alcohol of tranformed plants.

U.S. Pat. No. 5,908,975 concerns methods for synthesis and accumulation of fructose polymers in transgenic plants by selective expression of bacterial fructosyltransferase genes using tissue specific promoters and a vacuole targeting sequence.

WO89/12386 describes a method for the production of glucose and fructose polymers in transgenic tomato plants.

A stress tolerance sequences including proteins like galactinol synthase (GOLS) and raffinose synthase (RAFS), which are up regulated in response to stress and lead to the production of raffinose is disclosed in US 20050055748.

U.S. Pat. No. 6,887,708 provides nucleotide sequences encoding polypeptides having the function of GIGANTEA gene of *Arabidopsis thalaiana* which allows the manipulation of the starch accumulation process in plants.

Grain having an embryo with a genotype heterozygous for two or more wild type genes (for example, Aa/Bb) and an endosperm having a genotype heterozygous for such genes and leading to plants with altered the normal starch synthesis pathway is disclosed in US 20050091716.

Nevertheless, there is a constant need for providing novel enzyme activities or direct or indirect regulators and thus alternative methods with advantageous properties for producing carbohydrates, preferably polysaccharides like starch or cellulose and/or monosaccharides like fructose, glucose and/or myo-inositol and/or trisaccharides like raffinose and/or disaccharides like sucrose or its precursor in organisms, e.g. in transgenic organisms.

Another problem is the seasonal change in carbohydrate composition of plants and optimum harvest periods for are complicated by issues of timing.

To ensure constantly a high quality of foods and animal feeds, it is necessary to add one or a plurality of carbohydrates, preferably polysaccharides like starch or cellulose and/or monosaccharides like fructose, glucose and/or myo-inositol and/or trisaccharides like raffinose and/or disaccharides like sucrose in a balanced manner to suit the organism.

Accordingly, there is still a great demand for new and more suitable genes which encode enzymes which participate in the biosynthesis of carbohydrates, preferably polysaccharides like starch or cellulose and/or monosaccharides like fructose, glucose and/or myo-inositol and/or trisaccharides like raffinose and/or disaccharides like sucrose and make it possible to produce them specifically on an industrial scale without unwanted byproducts forming. In the selection of genes for or regulators of biosynthesis two characteristics above all are particularly important. On the one hand, there is as ever a need for improved processes for obtaining the highest possible contents of carbohydrates, preferably polysaccharides like starch or cellulose and/or monosaccharides like fructose, glucose and/or myo-inositol and/or trisaccharides like raffinose and/or disaccharides like sucrose; on the other hand as less as possible byproducts should be produced in the production process.

The added carbohydrates further beneficially affects the microflora by selectively stimulating the growth and/or activity of beneficial bacteria.

Another aspect is the significant reduction of cost of production and manufacturing not only to the nutrition, in particular sweetener industry, but also agriculture and cosmetic and health industry.

for the disclosure of this paragraph see [0013.0.0.0] above.

Accordingly, in a first embodiment, the invention relates to a process for the production of a fine chemical, whereby the fine chemical is myo-inositol, fructose, glucose, UDP-glucose, raffinose and/or starch and/or cellulose in free or bound form for example bound to lipids, proteins or carbohydrates. Accordingly, in the present invention, the term "the fine chemical" as used herein relates to "myo-inositol, fructose, glucose, UDP-glucose, raffinose and/or starch and/cellulose in free or bound form". Further, the term "the fine chemicals" as used herein also relates to fine chemicals comprising myo-inositol, fructose, glucose, UDP-glucose, raffinose and/or starch and/or cellulose in free or bound form.

A measure for the content of the polysaccharides, preferably starch and cellulose, of the invention can be the content of anhydroglucose. This compound is the analyte, which indicates the presence of the polysaccharides, preferably starch and cellulose, of the invention if the samples are prepared and measured as described in the examples In one embodiment, the term "myo-inositol, fructose, glucose, UDP-glucose, raffinose and/or starch and/or cellulose in free or bound form", "the fine chemical" or "the respective fine chemical" means at least one chemical compound selected from the group consisting of myo-inositol, fructose, glucose, UDP-glucose, raffinose and/or starch and/or cellulose or mixtures thereof in free or bound form.

Throughout the specification the term "the fine chemical" or "the respective fine chemical" means a compound selected from the group myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids.

In one embodiment, the term "the fine chemical" and the term "the respective fine chemical" mean at least one chemical compound with an activity of the abovementioned fine chemical.

In one embodiment, the term "the fine chemical" and the term "the respective fine chemical" mean at least one chemical compound with an activity of the above mentioned fine chemical Accordingly, the present invention relates to a process for the production of myo-inositol, fructose, glucose, UDP-glucose, raffinose and/or starch and/or cellulose in free or bound form, which comprises (a) increasing or generating the activity of a protein as shown in table II, application no. 20, column 3 encoded by the nucleic acid sequences as shown in table I, application no. 20, column 5, in an organelle of a microorganism or plant, or (b) increasing or generating the activity of a protein as shown in table II, application no. 20, column 3 encoded by the nucleic acid sequences as shown in table I, application no. 20, column 5 in the plastid of a microorganism or plant, or in one or more parts thereof; and (c) growing the organism under conditions which permit the production of the fine chemical, thus, myo-inositol, fructose, glucose, UDP-glucose, raffinose and/or starch and/or cellulose or fine chemicals comprising myo-inositol, fructose, glucose, UDP-glucose, raffinose and/or starch and/cellulose, are produced in said organism or in the culture medium surrounding the organism.

Accordingly, the term "the fine chemical" means "myo-inositol, fructose, glucose, UDP-glucose, raffinose and/or starch and/or cellulose in free or bound form" in relation to all sequences listed in table I, application no. 20, columns 5 and 7 or homologs thereof. Accordingly, the term "the fine chemical" can mean "myo-inositol, fructose, glucose, UDP-glucose, raffinose and/or starch and/or cellulose in free or bound form", owing to circumstances and the context. Preferably the term "the fine chemical" means "myo-inositol, fructose, glucose, UDP-glucose, raffinose and/or starch and/cellulose". In order to illustrate that the meaning of the term "the respective fine chemical" means "myo-inositol, fructose, glucose, UDP-glucose, raffinose and/or starch and/or cellulose in free or bound form" owing to the sequences listed in the context the term "the respective fine chemical" is also used.

In another embodiment the present invention is related to a process for the production of myo-inositol, fructose, glucose, UDP-glucose, raffinose and/or starch and/cellulose, which comprises (a) increasing or generating the activity of a protein as shown in table II, application no. 20, column 3 encoded by the nucleic acid sequences as shown in table I, application no. 20, column 5, in an organelle of a non-human organism, or (b) increasing or generating the activity of a protein as shown in table II, application no. 20, column 3 encoded by the nucleic acid sequences as shown in table I, application no. 20, column 5, which are joined to a nucleic acid sequence encoding a transit peptide in a non-human organism, or in one or more parts thereof; or (c) increasing or generating the activity of a protein as shown in table II, application no. 20, column 3 encoded by the nucleic acid sequences as shown in table I, application no. 20, column 5, which are joined to a nucleic acid sequence encoding chloroplast localization sequence, in a non-human organism, or in one or more parts thereof, and (d) growing the organism under conditions which permit the production of myo-inositol, fructose, glucose, UDP-glucose, raffinose and/or starch and/or cellulose in said organism.

In another embodiment, the present invention relates to a process for the production of myo-inositol, fructose, glucose, UDP-glucose, raffinose and/or starch and/cellulose, which comprises (a) increasing or generating the activity of a protein as shown in table II, application no. 20, column 3 encoded by the nucleic acid sequences as shown in table I, application no. 20, column 5, in an organelle of a microorganism or plant through the transformation of the organelle, or (b) increasing or generating the activity of a protein as shown in table II, application no. 20, column 3 encoded by the nucleic acid sequences as shown in table I, application no.

20, column 5 in the plastid of a microorganism or plant, or in one or more parts thereof through the transformation of the plastids; and (c) growing the organism under conditions which permit the production of the fine chemical, thus, myo-inositol, fructose, glucose, UDP-glucose, raffinose and/or starch and/or cellulose or fine chemicals comprising myo-inositol, fructose, glucose, UDP-glucose, raffinose and/or starch and/or cellulose in said organism or in the culture medium surrounding the organism.

Advantagously the activity of the protein as shown in table II, application no. 20, column 3 encoded by the nucleic acid sequences as shown in table I, application no. 20, column 5 is increased or generated in the abovementioned process in the plastid of a microorganism or plant.

for the disclosure of the paragraphs [0019.0.0.19] to [0024.0.0.19] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 20, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 20, column 3 and its homologs as disclosed in table I, application no. 20, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 20, column 3 and its homologs as disclosed in table I, application no. 20, columns 5 and 7.

for the disclosure of the paragraphs [0027.0.0.19] to [0029.0.0.19] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 20, columns 5 and 7. The person skilled in the art is able to join said sequences in a functional manner. Advantageously the transit peptide part is cleaved off from the protein part shown in table II, application no. 20, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 20, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 20, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 20, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 20, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 20, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.19] and [0030.3.0.19] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 20, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 20, columns 5 and 7 or a sequence encoding a protein, as depicted in table II, application no. 20, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 20, columns 5 and 7 or a sequence encoding a protein, as depicted in table II, application no. 20, columns 5 and 7 in such a manner that the viroid sequence transports a sequence transcribed from a sequence as depicted in table I, application no. 20, columns 5 and 7 or a sequence encoding a protein as depicted in table II, application no. 20, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 20, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 20, columns 5 and 7.

In a preferred embodiment of the invention the nucleic acid sequences as shown in table I, application no. 20, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 20, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.19] and [0032.0.0.19] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 20, column 3. Preferably the modification of the activity of a protein as shown in table II, application no. 20, column 3 or their combination can be achieved by joining the protein to a transit peptide.

Surprisingly it was found, that the transgenic expression of the *Saccaromyces cerevisiae* protein as shown in table II, application no. 20, column 3 in plastids of a plant such as *Arabidopsis thalaiana* for example through the linkage to at least one targeting sequence for example as mentioned in table V conferred an increase in the fine chemical content of the transformed plants.

for the disclosure of this paragraph see paragraph [0035.0.0.0] above.

The sequence of b0146 (Accession number A43671) from *Escherichia coli* has been published in Blattner et al., *Science* 277 (5331), 1453-1474 (1997), and its activity is being defined as "sugar fermentation stimulation protein". Accordingly, in one embodiment, the process of the present invention comprises the use of a "sugar fermentation stimulation protein" or its homolog, e.g. as shown herein, for the production of the fine chemical, meaning of starch and/or cellulose in free or bound from, in particular for increasing the amount of starch and/or cellulose in free or bound form in an organism or a part thereof, as mentioned. In one embodiment, in the process of the present invention the activity of a b0146 protein is increased or generated, e.g. from *Escherichia coli* or a homolog thereof, preferably linked at least to one transit peptide as mentioned for example in table V.

In another embodiment, in the process of the present invention the activity of a b0146 protein is increased or generated in a subcellular compartment of the organism or organism cell such as in an organelle like a plastid or mitochondria. The sequence of b0342 (Accession number PIR:XXECTG) from *Escherichia coli* has been published in Blattner et al., *Science* 277 (5331), 1453-1474 (1997), and its activity is being defined as "thiogalactoside acetyltransferase". Accordingly, in one embodiment, the process of the present invention comprises the use of a "thiogalactoside acetyltransferase" or its homolog, e.g. as shown herein, for the production of the fine chemical, meaning of starch and/or cellulose in free or bound from, in particular for increasing the amount of starch and/or cellulose in free or bound form in an organism or a part thereof, as mentioned. In one embodiment, in the process of the present invention the activity of a b0342 protein is increased or generated, e.g. from *Escherichia coli* or a homolog thereof, preferably linked at least to one transit peptide as mentioned for example in table V.

In another embodiment, in the process of the present invention the activity of a b0342 protein is increased or generated in a subcellular compartment of the organism or organism cell such as in an organelle like a plastid or mitochondria.

The sequence of b0523 (Accession number DEECPE) from *Escherichia coli* has been published in Blattner et al., *Science* 277 (5331), 1453-1474 (1997), and its activity is being defined as "phosphoribosylaminoimidazole carboxylase=AIR carboxylase, catalytic subunit". Accordingly, in one embodiment, the process of the present invention comprises the use of a "phosphoribosylaminoimidazole carboxylase=AIR carboxylase, catalytic subunit" or its homolog, e.g. as shown herein, for the production of the fine chemical, meaning of starch and/or cellulose in free or bound from, in particular for increasing the amount of starch and/or cellulose in free or bound form in an organism or a part thereof, as mentioned. In one embodiment, in the process of the present invention the activity of a b0523 protein is increased or generated, e.g. from *Escherichia coli* or a homolog thereof, preferably linked at least to one transit peptide as mentioned for example in table V.

In another embodiment, in the process of the present invention the activity of a b0523 protein is increased or generated in a subcellular compartment of the organism or organism cell such as in an organelle like a plastid or mitochondria. The sequence of b0598 (Accession number QOECNA) from *Escherichia coli* has been published in Blattner et al., *Science* 277 (5331), 1453-1474 (1997), and its activity is being defined as "carbon starvation protein". Accordingly, in one embodiment, the process of the present invention comprises the use of a "carbon starvation protein" or its homolog, e.g. as shown herein, for the production of the fine chemical, meaning of glucose in free or bound from, in particular for increasing the amount of glucose in free or bound form in an organism or a part thereof, as mentioned. In one embodiment, in the process of the present invention the activity of a b0598 protein is increased or generated, e.g. from *Escherichia coli* or a homolog thereof, preferably linked at least to one transit peptide as mentioned for example in table V.

In another embodiment, in the process of the present invention the activity of a b0598 protein is increased or generated in a subcellular compartment of the organism or organism cell such as in an organelle like a plastid or mitochondria.

The sequence of b0644 (Accession number B64799) from *Escherichia coli* has been published in Blattner et al., *Science* 277 (5331), 1453-1474 (1997), and its activity is being defined as a "hypothetical protein". Accordingly, in one embodiment, the process of the present invention comprises the use of a "uncharacterized protein" or its homolog, e.g. as shown herein, for the production of the fine chemical, meaning of starch and/or cellulose in free or bound from, in particular for increasing the amount of starch and/or cellulose in free or bound form in an organism or a part thereof, as mentioned. In one embodiment, in the process of the present invention the activity of a b0644 protein is increased or generated, e.g. from *Escherichia coli* or a homolog thereof, preferably linked at least to one transit peptide as mentioned for example in table V. In another embodiment, in the process of the present invention the activity of a b0644 protein is increased or generated in a subcellular compartment of the organism or organism cell such as in an organelle like a plastid or mitochondria. The sequence of b0760 (Accession number JC6038) from *Escherichia coli* has been published in Blattner et al., *Science* 277 (5331), 1453-1474 (1997), and its activity is being defined as "ATP-binding component of molybdate transport system". Accordingly, in one embodiment, the process of the present invention comprises the use of a "ATP-binding component of molybdate transport system" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a b0760 protein is increased or generated, e.g. from *Escherichia coli* or a homolog thereof, preferably linked at least to one transit peptide as mentioned for example in table V.

In another embodiment, in the process of the present invention the activity of a b0760 protein is increased or generated in a subcellular compartment of the organism or organism cell such as in an organelle like a plastid or mitochondria.

The sequence of b1046 (Accession number PIR:C64847) from *Escherichia coli* has been published in Blattner et al., *Science* 277 (5331), 1453-1474 (1997), and its activity is being defined as "putative synthase with phospholipase D/nuclease domain". Accordingly, in one embodiment, the process of the present invention comprises the use of a "putative synthase with phospholipase D/nuclease domain" or its homolog, e.g. as shown herein, for the production of the fine chemical, meaning of starch and/or cellulose in free or bound from, in particular for increasing the amount of starch and/or cellulose in free or bound form in an organism or a part thereof, as mentioned. In one embodiment, in the process of the present invention the activity of a b1046 protein is increased or generated, e.g. from *Escherichia coli* or a homolog thereof, preferably linked at least to one transit peptide as mentioned for example in table V.

In another embodiment, in the process of the present invention the activity of a b1046 protein is increased or generated in a subcellular compartment of the organism or organism cell such as in an organelle like a plastid or mitochondria.

The sequence of b1095 (Accession number NP_415613) from *Escherichia coli* has been published in Blattner et al., Science 277 (5331), 1453-1474 (1997), and its activity is being defined as "3-oxoacyl-[acyl-carrier-protein] synthase II". Accordingly, in one embodiment, the process of the present invention comprises the use of a "3-oxoacyl[acyl-carrier-protein] synthase II" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a b1095 protein is increased or generated, e.g. from *Escherichia coli* or a homolog thereof, preferably linked at least to one transit peptide as mentioned for example in table V.

In another embodiment, in the process of the present invention the activity of a b1095 protein is increased or generated in a subcellular compartment of the organism or organism cell such as in an organelle like a plastid or mitochondria.

The sequence of b1095 (Accession number NP_415613) from *Escherichia coli* has been published in Blattner et al., Science 277 (5331), 1453-1474 (1997), and its activity is being defined as "3-oxoacyl-[acyl-carrier-protein] synthase II". Accordingly, in one embodiment, the process of the present invention comprises the use of a "3-oxoacyl-[acyl-carrier-protein] synthase II" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a b1095 protein is increased or generated, e.g. from *Escherichia coli* or a homolog thereof, preferably linked at least to one transit peptide as mentioned for example in table V.

In another embodiment, in the process of the present invention the activity of a b1095 protein is increased or generated in a subcellular compartment of the organism or organism cell such as in an organelle like a plastid or mitochondria.

The sequence of b1095 (Accession number NP_415613) from *Escherichia coli* has been published in Blattner et al., Science 277 (5331), 1453-1474 (1997), and its activity is being defined as "3-oxoacyl-[acyl-carrier-protein] synthase II". Accordingly, in one embodiment, the process of the present invention comprises the use of a "3-oxoacyl[acyl-carrier-protein] synthase II" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a b1095 protein is increased or generated, e.g. from *Escherichia coli* or a homolog thereof, preferably linked at least to one transit peptide as mentioned for example in table V.

In another embodiment, in the process of the present invention the activity of a b1095 protein is increased or generated in a subcellular compartment of the organism or organism cell such as in an organelle like a plastid or mitochondria.

In another embodiment, in the process of the present invention the activity of a b1095 protein is increased or generated in a subcellular compartment of the organism or organism cell such as in an organelle like a plastid or mitochondria. Furthermore in one embodiment, the process of the present invention comprises the use of a "3-oxoacyl[acyl-carrier-protein] synthase II" or its homolog, e.g. as shown herein for the production of the fine chemicals, in particular for increasing the amount of one or of any combination of 2 or 3 of the fine chemicals, e.g. compounds, selected from the group of "fructose, glucose and myo-inositol".

The sequence of b1136 (Accession number PIR:DCECIS) from *Escherichia coli* has been published in Blattner et al., Science 277 (5331), 1453-1474 (1997), and its activity is being defined as "isocitrate dehydrogenase (NADP)". Accordingly, in one embodiment, the process of the present invention comprises the use of a "isocitrate dehydrogenase (NADP)" or its homolog, e.g. as shown herein, for the production of the fine chemical, meaning of starch and/or cellulose in free or bound form, in particular for increasing the amount of starch and/or cellulose in free or bound form in an organism or a part thereof, as mentioned. In one embodiment, in the process of the present invention the activity of a b1136 protein is increased or generated, e.g. from *Escherichia coli* or a homolog thereof, preferably linked at least to one transit peptide as mentioned for example in table V.

In another embodiment, in the process of the present invention the activity of a b1136 protein is increased or generated in a subcellular compartment of the organism or organism cell such as in an organelle like a plastid or mitochondria.

The sequence of b1399 (Accession number B64891) from *Escherichia coli* has been published in Blattner et al., Science 277 (5331), 1453-1474 (1997), and its activity is being defined as "phenylacetic acid degradation operon negative regulatory protein paaX". Accordingly, in one embodiment, the process of the present invention comprises the use of a "phenylacetic acid degradation operon negative regulatory protein paaX" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a b1399 protein is increased or generated, e.g. from *Escherichia coli* or a homolog thereof, preferably linked at least to one transit peptide as mentioned for example in table V.

In another embodiment, in the process of the present invention the activity of a b1399 protein is increased or generated in a subcellular compartment of the organism or organism cell such as in an organelle like a plastid or mitochondria.

The sequence of b1410 (Accession number NP_415928) from *Escherichia coli* has been published in Blattner et al., Science 277 (5331), 1453-1474 (1997), and its activity is being defined as "putative methylase with S-adenosyl-L-methionine-dependent methyltransferase domain and alpha/beta-hydrolase domain". Accordingly, in one embodiment, the process of the present invention comprises the use of a "putative methylase with S-adenosyl-L-methionine-dependent methyltransferase domain and alpha/beta-hydrolase domain" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a b1410 protein is increased or generated, e.g. from *Escherichia coli* or a homolog thereof, preferably linked at least to one transit peptide as mentioned for example in table V.

In another embodiment, in the process of the present invention the activity of a b1410 protein is increased or generated in a subcellular compartment of the organism or organism cell such as in an organelle like a plastid or mitochondria.

The sequence of b1410 (Accession number NP_415928) from *Escherichia coli* has been published in Blattner et al., Science 277 (5331), 1453-1474 (1997), and its activity is being defined as "putative methylase with S-adenosyl-L-methionine-dependent methyltransferase domain and alpha/beta-hydrolase domain". Accordingly, in one embodiment, the process of the present invention comprises the use of a "putative methylase with S-adenosyl-L-methionine-dependent methyltransferase domain and alpha/beta-hydrolase domain" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a b1410 protein is increased or generated, e.g. from *Escherichia coli* or a homolog thereof, preferably linked at least to one transit peptide as mentioned for example in table V.

In another embodiment, in the process of the present invention the activity of a b1410 protein is increased or generated in a subcellular compartment of the organism or organism cell such as in an organelle like a plastid or mitochondria.

The sequence of b1410 (Accession number NP_415928) from *Escherichia coli* has been published in Blattner et al., Science 277 (5331), 1453-1474 (1997), and its activity is being defined as "putative methylase with S-adenosyl-L-methionine-dependent methyltransferase domain and alpha/beta-hydrolase domain". Accordingly, in one embodiment, the process of the present invention comprises the use of a "putative methylase with S-adenosyl-L-methionine-dependent methyltransferase domain and alpha/beta-hydrolase domain" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a b1410 protein is increased or generated, e.g. from *Escherichia coli* or a homolog thereof, preferably linked at least to one transit peptide as mentioned for example in table V.

In another embodiment, in the process of the present invention the activity of a b1410 protein is increased or generated in a subcellular compartment of the organism or organism cell such as in an organelle like a plastid or mitochondria.

In another embodiment, in the process of the present invention the activity of a b1410 protein is increased or generated in a subcellular compartment of the organism or organism cell such as in an organelle like a plastid or mitochondria. Furthermore in one embodiment, the process of the present invention comprises the use of a "putative methylase with S-adenosyl-L-methionine-dependent methyltransferase domain and alpha/beta-hydrolase domain" or its homolog, e.g. as shown herein for the production of the fine chemicals, in particular for increasing the amount of one or of any combination of 2 or 3 of the fine chemicals, e.g. compounds, selected from the group of "fructose, glucose and myo-inositol".

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of sucrose in free or bound form, in particular for increasing the amount of sucrose in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

The sequence of b1556 (Accession number NP_416074) from *Escherichia coli* has been published in Blattner et al., Science 277 (5331), 1453-1474 (1997), and its activity is being defined as "Qin prophage". Accordingly, in one embodiment, the process of the present invention comprises the use of a "Qin prophage" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a b1556 protein is increased or generated, e.g. from *Escherichia coli* or a homolog thereof, preferably linked at least to one transit peptide as mentioned for example in table V.

In another embodiment, in the process of the present invention the activity of a b1556 protein is increased or generated in a subcellular compartment of the organism or organism cell such as in an organelle like a plastid or mitochondria.

In another embodiment, in the process of the present invention the activity of a b1556 protein is increased or generated in a subcellular compartment of the organism or organism cell such as in an organelle like a plastid or mitochondria. Furthermore in one embodiment, the process of the present invention comprises the use of a "Qin prophage" or its homolog, e.g. as shown herein for the production of the fine chemicals, in particular for increasing the amount of one or of any combination of 2 or 3 of the fine chemicals, e.g. compounds, selected from the group of "sucrose, raffinose and myoinositol".

The sequence of b1704 (Accession number NP_416219) from *Escherichia coli* has been published in Blattner et al., Science 277 (5331), 1453-1474 (1997), and its activity is being defined as "3-deoxy-D-arabinoheptulosonate-7-phosphate synthase (DAHP synthetase)". Accordingly, in one embodiment, the process of the present invention comprises the use of a "3-deoxy-D-arabinoheptulosonate-7-phosphate synthase (DAHP synthetase)" or its homolog, e.g. as shown herein, for the production of the fine chemical, meaning of starch and/or cellulose in free or bound form, in particular for increasing the amount of starch and/or cellulose in free or bound form in an organism or a part thereof, as mentioned. In one embodiment, in the process of the present invention the activity of a b1704 protein is increased or generated, e.g. from *Escherichia coli* or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b1980 (Accession number F64962) from *Escherichia coli* has been published in Blattner et al., Science 277 (5331), 1453-1474 (1997), and its activity is being defined as "putative transport protein". Accordingly, in one embodiment, the process of the present invention comprises the use of a "putative transport protein" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a b1980 protein is increased or generated, e.g. from *Escherichia coli* or a homolog thereof, preferably linked at least to one transit peptide as mentioned for example in table V.

In another embodiment, in the process of the present invention the activity of a b1980 protein is increased or generated in a subcellular compartment of the organism or organism cell such as in an organelle like a plastid or mitochondria.

The sequence of b2223 (Accession number NP_416727) from *Escherichia coli* has been published in Blattner et al., Science 277 (5331), 1453-1474 (1997), and its activity is being defined as "short chain fatty acid transporter". Accordingly, in one embodiment, the process of the present invention comprises the use of a "short chain fatty acid transporter" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a b2223 protein is increased or generated, e.g. from *Escherichia coli* or a homolog thereof, preferably linked at least to one transit peptide as mentioned for example in table V.

In another embodiment, in the process of the present invention the activity of a b2223 protein is increased or generated in a subcellular compartment of the organism or organism cell such as in an organelle like a plastid or mitochondria.

The sequence of b2223 (Accession number NP_416727) from *Escherichia coli* has been published in Blattner et al., Science 277 (5331), 1453-1474 (1997), and its activity is being defined as "short chain fatty acid transporter". Accordingly, in one embodiment, the process of the present invention comprises the use of a "short chain fatty acid transporter" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a b2223 protein is increased or generated, e.g. from *Escherichia coli* or a homolog thereof, preferably linked at least to one transit peptide as mentioned for example in table V.

In another embodiment, in the process of the present invention the activity of a b2223 protein is increased or generated in a subcellular compartment of the organism or organism cell such as in an organelle like a plastid or mitochondria.

The sequence of b2223 (Accession number NP_416727) from *Escherichia coli* has been published in Blattner et al., Science 277 (5331), 1453-1474 (1997), and its activity is being defined as "short chain fatty acid transporter". Accordingly, in one embodiment, the process of the present invention comprises the use of a "short chain fatty acid transporter" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a b2223 protein is increased or generated, e.g. from *Escherichia coli* or a homolog thereof, preferably linked at least to one transit peptide as mentioned for example in table V.

In another embodiment, in the process of the present invention the activity of a b2223 protein is increased or generated in a subcellular compartment of the organism or organism cell such as in an organelle like a plastid or mitochondria.

In another embodiment, in the process of the present invention the activity of a b2223 protein is increased or generated in a subcellular compartment of the organism or organism cell such as in an organelle like a plastid or mitochondria. Furthermore in one embodiment, the process of the present invention comprises the use of a "short chain fatty acid transporter" or its homolog, e.g. as shown herein for the production of the fine chemicals, in particular for increasing the amount of one or of any combination of 2 or 3 of the fine chemicals, e.g. compounds, selected from the group of "glucose, raffinose and myo-inositol".

The sequence of b2284 (Accession number B65000) from *Escherichia coli* has been published in Blattner et al., Science 277 (5331), 1453-1474 (1997), and its activity is being defined as "NADH2 dehydrogenase". Accordingly, in one embodiment, the process of the present invention comprises the use of a "NADH2 dehydrogenase" or its homolog, e.g. as shown herein, for the production of the fine chemical, meaning of starch and/or cellulose in free or bound form, in particular for increasing the amount of starch and/or cellulose in free or bound form in an organism or a part thereof, as mentioned. In one embodiment, in the process of the present invention the activity of a b2284 protein is increased or generated, e.g. from *Escherichia coli* or a homolog thereof, preferably linked at least to one transit peptide as mentioned for example in table V.

In another embodiment, in the process of the present invention the activity of a b2284 protein is increased or generated in a subcellular compartment of the organism or organism cell such as in an organelle like a plastid or mitochondria.

The sequence of b2240 (Accession number JNECGT) from *Escherichia coli* has been published in Blattner et al., Science 277 (5331), 1453-1474 (1997), and its activity is being defined as "glycerol-3-phosphate transport protein". Accordingly, in one embodiment, the process of the present invention comprises the use of a "glycerol-3phosphate transport protein" or its homolog, e.g. as shown herein, for the production of the fine chemical, meaning of starch and/or cellulose in free or bound form, in particular for increasing the amount of starch and/or cellulose in free or bound form in an organism or a part thereof, as mentioned. In one embodiment, in the process of the present invention the activity of a b2240 protein is increased or generated, e.g. from *Escherichia coli* or a homolog thereof, preferably linked at least to one transit peptide as mentioned for example in table V.

In another embodiment, in the process of the present invention the activity of a b2240 protein is increased or generated in a subcellular compartment of the organism or organism cell such as in an organelle like a plastid or mitochondria.

The sequence of b2965 (Accession number NP_417440) from *Escherichia coli* has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of sucrose in free or bound form, in particular for increasing the amount of sucrose in free or bound form in an organism or a part thereof, as mentioned. In one embodiment, in the process of the present invention the activity of a b2965 protein is increased or generated, e.g. from *Escherichia coli* or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b3156 (Accession number H65105) from *Escherichia coli* has been published in Blattner et al., Science 277 (5331), 1453-1474 (1997), and its activity is being defined as "putative acyl-CoA N-acyltransferase". Accordingly, in one embodiment, the process of the present invention comprises the use of a "putative acyl-CoA N-acyltransferase" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a b3156 protein is increased or generated, e.g. from *Escherichia coli* or a homolog thereof, preferably linked at least to one transit peptide as mentioned for example in table V.

In another embodiment, in the process of the present invention the activity of a b3156 protein is increased or generated in a subcellular compartment of the organism or organism cell such as in an organelle like a plastid or mitochondria.

The sequence of b3708 (Accession number WZEC) from *Escherichia coli* has been published in Blattner et al., Science 277 (5331), 1453-1474 (1997), and its activity is being defined as "tryptophan deaminase, PLP-dependent". Accordingly, in one embodiment, the process of the present invention comprises the use of a "tryptophan deaminase, PLP-dependent" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a b3708 protein is increased or generated, e.g. from *Escherichia coli* or a homolog thereof, preferably linked at least to one transit peptide as mentioned for example in table V.

In another embodiment, in the process of the present invention the activity of a b3708 protein is increased or generated in a subcellular compartment of the organism or organism cell such as in an organelle like a plastid or mitochondria.

The sequence of YCR012W (Accession number KIBYG) from *Saccharomyces cerevisiae* has been published in Goffeau et al., Science 274 (5287), 546-547, 1996, and its activity is being defined as "3-phosphoglycerate kinase". Accordingly, in one embodiment, the process of the present invention comprises the use of a "3-phosphoglycerate kinase" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a YCR012W protein is increased or generated, e.g. from *Saccharomyces cerevisiae* or a homolog thereof, preferably linked at least to one transit peptide as mentioned for example in table V.

In another embodiment, in the process of the present invention the activity of a YCR012W protein is increased or generated in a subcellular compartment of the organism or organism cell such as in an organelle like a plastid or mitochondria.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase" which catalyzes the first step in aromatic amino acid biosynthesis and is feedback-inhibited by phenylalanine (Aro3p). Accordingly, in one embodiment, the process of the present invention comprises the use of a "3-deoxy-D-arabino-heptulosonate-7-phosphate synthase" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of an YDR035W protein is increased or generated in a subcellular compartment of the organism or organism cell such as in an organelle like a plastid or mitochondria.

The sequence of YDR497C (Accession number NP_010785) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "myo-inositol transporter". Accordingly, in one embodiment, the process of the present invention comprises the use of a "myo-inositol transporter" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a YDR497C protein is increased or generated, e.g. from *Saccharomyces cerevisiae* or a homolog thereof, preferably linked at least to one transit peptide as mentioned for example in table V.

In another embodiment, in the process of the present invention the activity of an YDR497C protein is increased or generated in a subcellular compartment of the organism or organism cell such as in an organelle like a plastid or mitochondria.

The sequence of YDR497C (Accession number NP_010785) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "myo-inositol transporter". Accordingly, in one embodiment, the process of the present invention comprises the use of a "myo-inositol transporter" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a YDR497C protein is increased or generated, e.g.

from *Saccharomyces cerevisiae* or a homolog thereof, preferably linked at least to one transit peptide as mentioned for example in table V.

In another embodiment, in the process of the present invention the activity of an YDR497C protein is increased or generated in a subcellular compartment of the organism or organism cell such as in an organelle like a plastid or mitochondria.

In another embodiment, in the process of the present invention the activity of a YDR497C protein is increased or generated in a subcellular compartment of the organism or organism cell such as in an organelle like a plastid or mitochondria. Furthermore in one embodiment, the process of the present invention comprises the use of a "myoinositol transporter" or its homolog, e.g. as shown herein for the production of the fine chemicals, in particular for increasing the amount of fructose and myo-inositol.

The sequence of YER063W (Accession number S50566) from *Saccharomyces cerevisiae* has been published in Goffeau et al., Science 274 (5287), 546-547, 1996 and Dietrich et al., Nature 387 (6632 Suppl), 78-81 (1997), and its activity is being defined as a "uncharacterized protein". Accordingly, in one embodiment, the process of the present invention comprises the use of a "uncharacterized protein" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a YER063W protein is increased or generated, e.g. from *Saccharomyces cerevisiae* or a homolog thereof, preferably linked at least to one transit peptide as mentioned for example in table V.

In another embodiment, in the process of the present invention the activity of an YER063W protein is increased or generated in a subcellular compartment of the organism or organism cell such as in an organelle like a plastid or mitochondria.

The sequence of YGL065C (Accession number S64069) from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "ALG2 protein precursor". Accordingly, in one embodiment, the process of the present invention comprises the use of a "ALG2 protein precursor" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a YGL065C protein is increased or generated, e.g. from *Saccharomyces cerevisiae* or a homolog thereof, preferably linked at least to one transit peptide as mentioned for example in table V.

In another embodiment, in the process of the present invention the activity of an YGL065C protein is increased or generated in a subcellular compartment of the organism or organism cell such as in an organelle like a plastid or mitochondria.

The sequence of YGL065C (Accession number S64069) from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "ALG2 protein precursor". Accordingly, in one embodiment, the process of the present invention comprises the use of a "ALG2 protein precursor" or its homolog, e.g. as shown herein, for the production of the fine chemical, meaning of starch and/or cellulose in free or bound form, in particular for increasing the amount of starch and/or cellulose in free or bound form in an organism or a part thereof, as mentioned. In one embodiment, in the process of the present invention the activity of a YGL065C protein is increased or generated, e.g. from *Saccharomyces cerevisiae* or a homolog thereof, preferably linked at least to one transit peptide as mentioned for example in table V.

In another embodiment, in the process of the present invention the activity of an YGL065C protein is increased or generated in a subcellular compartment of the organism or organism cell such as in an organelle like a plastid or mitochondria.

In another embodiment, in the process of the present invention the activity of an YGL065C protein is increased or generated in a subcellular compartment of the organism or organism cell such as in an organelle like a plastid or mitochondria. Furthermore in one embodiment, the process of the present invention comprises the use of a "ALG2 protein precursor" or its homolog, e.g. as shown herein for the production of the fine chemicals, in particular for increasing the amount of one or of any combination of the fine chemicals, e.g. compounds, selected from the group of "starch and/or cellulose and myo-inositol".

The sequence of YGR255C (Accession number NP_011771) from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "putative flavin-dependent monooxygenase" (Coq6p), which is involved in ubiquinone (Coenzyme Q) biosynthesis". Accordingly, in one embodiment, the process of the present invention comprises the use of a "putative flavin-dependent monooxygenase" (Coq6p), which is involved in ubiquinone (Coenzyme Q) biosynthesis" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a YGR255C protein is increased or generated, e.g. from *Saccharomyces cerevisiae* or a homolog thereof, preferably linked at least to one transit peptide as mentioned for example in table V.

In another embodiment, in the process of the present invention the activity of an YGR255C protein is increased or generated in a subcellular compartment of the organism or organism cell such as in an organelle like a plastid or mitochondria.

The sequence of YGR255C (Accession number NP_011771) from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "putative flavin-dependent monooxygenase" (Coq6p), which is involved in ubiquinone (Coenzyme Q) biosynthesis". Accordingly, in one embodiment, the process of the present invention comprises the use of a "putative flavin-dependent monooxygenase" (Coq6p), which is involved in ubiquinone (Coenzyme Q) biosynthesis" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a YGR255C protein is increased or generated, e.g. from *Saccharomyces cerevisiae* or a homolog thereof, preferably linked at least to one transit peptide as mentioned for example in table V.

In another embodiment, in the process of the present invention the activity of an YGR255C protein is increased or generated in a subcellular compartment of the organism or organism cell such as in an organelle like a plastid or mitochondria.

In another embodiment, in the process of the present invention the activity of a YGR255C protein is increased or generated in a subcellular compartment of the organism or organism cell such as in an organelle like a plastid or mitochondria. Furthermore in one embodiment, the process of the present invention comprises the use of a "putative flavin-dependent monooxygenase" (Coq6p), which is involved in ubiquinone (Coenzyme Q) biosynthesis" or its homolog, e.g. as shown herein for the production of the fine chemicals, in particular for increasing the amount of glucose and raffinose.

The sequence of YGR262C (Accession number S64595) from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "protein involved in bud-site selection". Accordingly, in one embodiment, the process of the present invention comprises the use of a "protein involved in bud-site selection" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a YGR262C protein is increased or generated, e.g. from *Saccharomyces cerevisiae* or a homolog thereof, preferably linked at least to one transit peptide as mentioned for example in table V.

In another embodiment, in the process of the present invention the activity of an YGR262C protein is increased or generated in a subcellular compartment of the organism or organism cell such as in an organelle like a plastid or mitochondria.

The sequence of YGR262C (Accession number S64595) from *Saccharomyces cerevisiae* has been published in Tettelin et al., Nature 387 (6632 Suppl), 81-84 (1997), and Goffeau et al., Science 274 (5287), 546-547, 1996, and its activity is being defined as a "protein involved in bud-site selection". Accordingly, in one embodiment, the process of the present invention comprises the use of a "protein involved in bud-site selection" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a YGR262C protein is increased or generated, e.g. from *Saccharomyces cerevisiae* or a homolog thereof, preferably linked at least to one transit peptide as mentioned for example in table V.

In another embodiment, in the process of the present invention the activity of an YGR262C protein is increased or generated in a subcellular compartment of the organism or organism cell such as in an organelle like a plastid or mitochondria.

In another embodiment, in the process of the present invention the activity of a YGR262C protein is increased or generated in a subcellular compartment of the organism or organism cell such as in an organelle like a plastid or mitochondria. Furthermore in one embodiment, the process of the present invention comprises the use of a "protein involved in bud-site selection" or its homolog, e.g. as shown herein for the production of the fine chemicals, in particular for increasing the amount of glucose and fructose.

The sequence of YHR204W (Accession number S46693) from *Saccharomyces cerevisiae* has been published in Goffeau et al., Science 274 (5287), 546-547, 1996, and its activity is being defined as a "mannosidase like protein". Accordingly, in one embodiment, the process of the present invention comprises the use of a "mannosidase like protein" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a YHR204W protein is increased or generated, e.g. from *Saccharomyces cerevisiae* or a homolog thereof, preferably linked at least to one transit peptide as mentioned for example in table V.

In another embodiment, in the process of the present invention the activity of an YHR204W protein is increased or generated in a subcellular compartment of the organism or organism cell such as in an organelle like a plastid or mitochondria.

The sequence of YIR020W-A (Accession number Q03886_YEAST) from *Saccharomyces cerevisiae* has been published in the UniProtKB/TrEMBL database and its activity is being defined as a "protein of unknown function". Accordingly, in one embodiment, the process of the present invention comprises the use of a "protein of unknown function" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a YIR020W-A protein is increased or generated, e.g. from *Saccharomyces cerevisiae* or a homolog thereof, preferably linked at least to one transit peptide as mentioned for example in table V.

In another embodiment, in the process of the present invention the activity of an YIR020W-A protein is increased or generated in a subcellular compartment of the organism or organism cell such as in an organelle like a plastid or mitochondria.

The sequence of YIR020W-A (Accession number Q03886_YEAST) from *Saccharomyces cerevisiae* has been published in the UniProtKB/TrEMBL database, and its activity is being defined as a "protein of unknown function". Accordingly, in one embodiment, the process of the present invention comprises the use of a "protein of unknown function" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a YIR020W-A protein is increased or generated, e.g. from *Saccharomyces cerevisiae* or a homolog thereof, preferably linked at least to one transit peptide as mentioned for example in table V.

In another embodiment, in the process of the present invention the activity of an YIR020W-A protein is increased or generated in a subcellular compartment of the organism or organism cell such as in an organelle like a plastid or mitochondria.

In another embodiment, in the process of the present invention the activity of a YIRO20W-A protein is increased or generated in a subcellular compartment of the organism or organism cell such as in an organelle like a plastid or mitochondria. Furthermore in one embodiment, the process of the present invention comprises the use of a "protein of unknown function" or its homolog, e.g. as shown herein for the production of the fine chemicals, in particular for increasing the amount of glucose and fructose.

The sequence of YJL139C (Accession number PIR: S36856) from *Saccharomyces cerevisiae* has been published in Foreman et al., Nucleic Acids Res. 19:2781-2781(1991), and its activity is being defined as a "mannosyltransferase of the KTR1 family, involved in protein N-glycosylation". Accordingly, in one embodiment, the process of the present invention comprises the use of a "mannosyltransferase of the KTR1 family, involved in protein N-glycosylation" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a YJL139C protein is increased or generated, e.g. from *Saccharomyces cerevisiae* or a homolog thereof, preferably linked at least to one transit peptide as mentioned for example in table V.

In another embodiment, in the process of the present invention the activity of an YJL139C protein is increased or generated in a subcellular compartment of the organism or organism cell such as in an organelle like a plastid or mitochondria.

The sequence of YJL139C (Accession number PIR: S36856) from *Saccharomyces cerevisiae* has been published in Foreman et al., Nucleic Acids Res. 19:2781-2781(1991), and its activity is being defined as a "mannosyltransferase of the KTR1 family, involved in protein N-glycosylation". Accordingly, in one embodiment, the process of the present invention comprises the use of a "mannosyltransferase of the KTR1 family, involved in protein N-glycosylation" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a YJL139C protein is increased or generated, e.g. from *Saccharomyces cerevisiae* or a homolog thereof, preferably linked at least to one transit peptide as mentioned for example in table V.

In another embodiment, in the process of the present invention the activity of an YJL139C protein is increased or generated in a subcellular compartment of the organism or organism cell such as in an organelle like a plastid or mitochondria.

In another embodiment, in the process of the present invention the activity of a YJL139C protein is increased or generated in a subcellular compartment of the organism or organism cell such as in an organelle like a plastid or mitochondria. Furthermore in one embodiment, the process of the present invention comprises the use of a "mannosyltransferase of the KTR1 family, involved in protein N-glycosylation" or its homolog, e.g. as shown herein for the production of the fine chemicals, in particular for increasing the amount of "myo-inositol and fructose.

The sequence of YKR043C (Accession number NP_012969) from *Saccharomyces cerevisiae* has been published in Goffeau et al., Science 274 (5287), 546-547, 1996, and its activity is being defined as a "phosphoglycerate mutase like protein". Accordingly, in one embodiment, the process of the present invention comprises the use of a "phosphoglycerate mutase like protein" or its homolog, e.g. as shown herein, for the production of the fine chemical, meaning of UDP-glucose in free or bound form, in particular for increasing the amount of UDP-glucose in free or bound form in an organism or a part thereof, as mentioned. In one embodiment, in the process of the present invention the activity of a YKR043C protein is increased or generated, e.g. from *Saccharomyces cerevisiae* or a homolog thereof, preferably linked at least to one transit peptide as mentioned for example in table V.

In another embodiment, in the process of the present invention the activity of an YKR043C protein is increased or generated in a subcellular compartment of the organism or organism cell such as in an organelle like a plastid or mitochondria.

The sequence of YLL033W (Accession number S64784) from *Saccharomyces cerevisiae* has been published in Johnston et al., Nature 387 (6632 Suppl), 87-90 (1997) and Goffeau et al., Science 274 (5287), 546-547, 1996, and its activity is being defined as a "uncharacterized". Accordingly, in one embodiment, the process of the present invention comprises the use of a "uncharacterized protein" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a YLL033W protein is increased or generated, e.g. from *Saccharomyces cerevisiae* or a homolog thereof, preferably linked at least to one transit peptide as mentioned for example in table V.

In another embodiment, in the process of the present invention the activity of an YLL033W protein is increased or generated in a subcellular compartment of the organism or organism cell such as in an organelle like a plastid or mitochondria.

The sequence of YLR153C (Accession number NP_013254) from *Saccharomyces cerevisiae* has been published in Johnston et al., Nature 387 (6632 Suppl), 87-90 (1997) and Goffeau et al., Science 274 (5287), 546-547, 1996, and its activity is being defined as a "acetyl CoA synthetase". Accordingly, in one embodiment, the process of the present invention comprises the use of a "acetyl CoA synthetase" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a YLR153C protein is increased or generated, e.g. from *Saccharomyces cerevisiae* or a homolog thereof, preferably linked at least to one transit peptide as mentioned for example in table V.

In another embodiment, in the process of the present invention the activity of an YLR153C protein is increased or generated in a subcellular compartment of the organism or organism cell such as in an organelle like a plastid or mitochondria.

The sequence of YLR174W (Accession number NP_013275) from *Saccharomyces cerevisiae* has been published in Goffeau et al., Science 274 (5287), 546-547, 1996 and Johnston et al., Nature 387 (6632 Suppl), 87-90 (1997), and its activity is being defined as a "NADP-dependent isocitrate dehydrogenase". Accordingly, in one embodiment, the process of the present invention comprises the use of a "NADP-dependent isocitrate dehydrogenase" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a YLR174W protein is increased or generated, e.g. from *Saccharomyces cerevisiae* or a homolog thereof, preferably linked at least to one transit peptide as mentioned for example in table V.

In another embodiment, in the process of the present invention the activity of an YLR174W protein is increased or generated in a subcellular compartment of the organism or organism cell such as in an organelle like a plastid or mitochondria.

The sequence of YLR174W (Accession number NP_013275) from *Saccharomyces cerevisiae* has been published in Goffeau et al., Science 274 (5287), 546-547, 1996 and Johnston et al., Nature 387 (6632 Suppl), 87-90 (1997), and its activity is being defined as a "NADP-dependent isocitrate dehydrogenase". Accordingly, in one embodiment, the process of the present invention comprises the use of a "NADP-dependent isocitrate dehydrogenase" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a YLR174W protein is increased or generated, e.g. from *Saccharomyces cerevisiae* or a homolog thereof, preferably linked at least to one transit peptide as mentioned for example in table V.

In another embodiment, in the process of the present invention the activity of an YLR174W protein is increased or generated in a subcellular compartment of the organism or organism cell such as in an organelle like a plastid or mitochondria.

In another embodiment, in the process of the present invention the activity of a YLR174W protein is increased or generated in a subcellular compartment of the organism or organism cell such as in an organelle like a plastid or mitochondria. Furthermore in one embodiment, the process of the present invention comprises the use of a "NADP-dependent isocitrate dehydrogenase" or its homolog, e.g. as shown herein for the production of the fine chemicals, in particular for increasing the amount of raffinose and myo-inositol.

The sequence of YNL022C (Accession number S62934) from *Saccharomyces cerevisiae* has been published in Goffeau et al., Science 274 (5287), 546-547, 1996 and Philippsen et al., Nature 387 (6632 Suppl), 93-98 (1997), and its activity is being defined as a "uncharacterized protein". Accordingly, in one embodiment, the process of the present invention comprises the use of a "uncharacterized protein" or its homolog, e.g. as shown herein, for the production of the fine chemical, meaning of raffinose in free or bound form, in particular for increasing the amount of raffinose in free or bound form in an organism or a part thereof, as mentioned. In one embodiment, in the process of the present invention the activity of a YNL022C protein is increased or generated, e.g. from *Saccharomyces cerevisiae* or a homolog thereof, preferably linked at least to one transit peptide as mentioned for example in table V.

In another embodiment, in the process of the present invention the activity of an YNL022C protein is increased or generated in a subcellular compartment of the organism or organism cell such as in an organelle like a plastid or mitochondria.

The sequence of YNL241C (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as a "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of an YNL241C protein is increased or generated in a subcellular compartment of the organism or organism cell such as in an organelle like a plastid or mitochondria.

The sequence of YNL241C (Accession number NP_014158) from *Saccharomyces cerevisiae* has been published in Goffeau et al., Science 274 (5287), 546-547, 1996 and Philippsen et al., Nature 387 (6632 Suppl), 93-98 (1997), and its activity is being defined as a "glucose-6-phosphate dehydrogenase". Accordingly, in one embodiment, the process of the present invention comprises the use of a "glucose-6-phosphate dehydrogenase" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a YNL241C protein is increased or generated, e.g. from *Saccharomyces cerevisiae* or a homolog thereof, preferably linked at least to one transit peptide as mentioned for example in table V.

In another embodiment, in the process of the present invention the activity of an YNL241C protein is increased or generated in a subceliular compartment of the organism or organism cell such as in an organelle like a plastid or mitochondria.

In another embodiment, in the process of the present invention the activity of a YNL241C protein is increased or generated in a subcellular compartment of the organism or organism cell such as in an organelle like a plastid or mitochondria. Furthermore in one embodiment, the process of the present invention comprises the use of a "glucose-6-phosphate dehydrogenase" or its homolog, e.g. as shown herein for the production of the fine chemicals, in particular for increasing the amount of glucose and fructose.

The sequence of YNR012W (Accession number NP_014409) from *Saccharomyces cerevisiae* has been published in Goffeau et al., Science 274 (5287), 546-547, 1996 and Philippsen et al., Nature 387 (6632 Suppl), 93-98 (1997), and its activity is being defined as a "uridine kinase". Accordingly, in one embodiment, the process of the present invention comprises the use of a "uridine kinase" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a YNR012W protein is increased or generated, e.g. from *Saccharomyces cerevisiae* or a homolog thereof, preferably linked at least to one transit peptide as mentioned for example in table V.

In another embodiment, in the process of the present invention the activity of an YNR012W protein is increased or generated in a subcellular compartment of the organism or organism cell such as in an organelle like a plastid or mitochondria.

The sequence of YOR353C (Accession number NP_014998) from *Saccharomyces cerevisiae* has been published in Goffeau et al., Science 274 (5287), 546-547, 1996 and Dujon et al., Nature 387 (6632 Suppl), 98-102 (1997), and its activity is being defined as a "protein required for cell morphogenesis and cell separation after mitosis; Sog2p". Accordingly, in one embodiment, the process of the present invention comprises the use of a "protein required for cell morphogenesis and cell separation after mitosis; Sog2p" or its homolog, e.g. as shown herein, for the production of the fine chemical, meaning of glucose in free or bound form, in particular for increasing the amount of glucose in free or bound form in an organism or a part thereof, as mentioned. In one embodiment, in the process of the present invention the activity of a YOR353C protein is increased or generated, e.g.

from *Saccharomyces cerevisiae* or a homolog thereof, preferably linked at least to one transit peptide as mentioned for example in table V.

In another embodiment, in the process of the present invention the activity of an YOR353C protein is increased or generated in a subcellular compartment of the organism or organism cell such as in an organelle like a plastid or mitochondria.

The sequence of YOR353C (Accession number NP_014998) from *Saccharomyces cerevisiae* has been published in Goffeau et al., Science 274 (5287), 546-547, 1996 and Dujon et al., Nature 387 (6632 Suppl), 98-102 (1997), and its activity is being defined as a "protein required for cell morphogenesis and cell separation after mitosis; Sog2p". Accordingly, in one embodiment, the process of the present invention comprises the use of a "protein required for cell morphogenesis and cell separation after mitosis; Sog2p" or its homolog, e.g. as shown herein, for the production of the fine chemical, meaning of fructose in free or bound form, in particular for increasing the amount of fructose in free or bound form in an organism or a part thereof, as mentioned. In one embodiment, in the process of the present invention the activity of a YOR353C protein is increased or generated, e.g. from *Saccharomyces cerevisiae* or a homolog thereof, preferably linked at least to one transit peptide as mentioned for example in table V.

In another embodiment, in the process of the present invention the activity of an YOR353C protein is increased or generated in a subcellular compartment of the organism or organism cell such as in an organelle like a plastid or mitochondria.

In another embodiment, in the process of the present invention the activity of a YOR353C protein is increased or generated in a subcellular compartment of the organism or organism cell such as in an organelle like a plastid or mitochondria. Furthermore in one embodiment, the process of the present invention comprises the use of a "protein required for cell morphogenesis and cell separation after mitosis; Sog2p" or its homolog, e.g. as shown herein for the production of the fine chemicals, in particular for increasing the amount of glucose and fructose.

The sequence of YPL138C (Accession number NP_015187) from *Saccharomyces cerevisiae* has been published in Bussey et al., Nature 387 (6632 Suppl), 103-105 (1997) and Goffeau et al., Science 274 (5287), 546-547, 1996, and its activity is being defined as a "compass (complex proteins associated with Set1p) component". Accordingly, in one embodiment, the process of the present invention comprises the use of a "compass (complex proteins associated with Set1p) component" or its homolog, e.g. as shown herein, for the production of the fine chemical, meaning of starch and/or cellulose in free or bound form, in particular for increasing the amount of starch and/or cellulose in free or bound form in an organism or a part thereof, as mentioned. In one embodiment, in the process of the present invention the activity of a YPL138C protein is increased or generated, e.g. from *Saccharomyces cerevisiae* or a homolog thereof, preferably linked at least to one transit peptide as mentioned for example in table V.

In another embodiment, in the process of the present invention the activity of an YPL138C protein is increased or generated in a subcellular compartment of the organism or organism cell such as in an organelle like a plastid or mitochondria.

The sequence of YPR035W (Accession number NP_015360) from *Saccharomyces cerevisiae* has been published in in Bussey et al., Nature 387 (6632 Suppl), 103-105 (1997) and Goffeau et al., Science 274 (5287), 546-547, 1996, and its activity is being defined as a "glutamine synthetase". Accordingly, in one embodiment, the process of the present invention comprises the use of a "glutamine synthetase" or its homolog, e.g. as shown herein, for the production of the fine chemical, meaning of myo-inositol in free or bound form, in particular for increasing the amount of myo-inositol in free or bound form in an organism or a part thereof, as mentioned. In one embodiment, in the process of the present invention the activity of a YPR035W protein is increased or generated, e.g. from *Saccharomyces cerevisiae* or a homolog thereof, preferably linked at least to one transit peptide as mentioned for example in table V.

In another embodiment, in the process of the present invention the activity of an YPR035W protein is increased or generated in a subcellular compartment of the organism or organism cell such as in an organelle like a plastid or mitochondria.

The sequence of YPR035W (Accession number NP_015360) from *Saccharomyces cerevisiae* has been published in in Bussey et al., Nature 387 (6632 Suppl), 103-105 (1997) and Goffeau et al., Science 274 (5287), 546-547, 1996, and its activity is being defined as a "glutamine synthetase". Accordingly, in one embodiment, the process of the present invention comprises the use of a "glutamine synthetase" or its homolog, e.g. as shown herein, for the production of raffinose in free or bound form, in particular for increasing the amount of raffinose in free or bound form in an organism or a part thereof, as mentioned. In one embodiment, in the process of the present invention the activity of a YPR035W protein is increased or generated, e.g. from *Saccharomyces cerevisiae* or a homolog thereof, preferably linked at least to one transit peptide as mentioned for example in table V.

In another embodiment, in the process of the present invention the activity of an YPR035W protein is increased or generated in a subcellular compartment of the organism or organism cell such as in an organelle like a plastid or mitochondria.

In another embodiment, in the process of the present invention the activity of a YPR035W protein is increased or generated in a subcellular compartment of the organism or organism cell such as in an organelle like a plastid or mitochondria. Furthermore in one embodiment, the process of the present invention comprises the use of a "glutamine synthetase" or its homolog, e.g. as shown herein for the production of the fine chemicals, in particular for increasing the amount of myo-inositol and raffinose.

In one embodiment, the homolog of the b0146, b0342, b0523, b0598, b0644, b0760, b1046, b1095, b1136, b1399, b1410, b1556, b1704, b1980, b2223, b2240, b2284, b2965, b3156b3708 is a homolog having said activity and being derived from bacteria. In one embodiment, the homolog of the b0146, b0342, b0523, b0598, b0644, b0760, b1046, b1095, b1136, b1399, b1410, b1556, b1704, b1980, b2223, b2240, b2284, b2965, b3156b3708 is a homolog having said activity and being derived from Proteobacteria. In one embodiment, the homolog of the b0146, b0342, b0523, b0598, b0644, b0760, b1046, b1095, b1136, b1399, b1410, b1556, b1704, b1980, b2223, b2240, b2284, b2965, b3156b3708 is a homolog having said activity and being derived from Gammaproteobacteria. In one embodiment, the homolog of the b0146, b0342, b0523, b0598, b0644, b0760, b1046, b1095, b1136, b1399, b1410, b1556, b1704, b1980, b2223, b2240, b2284, b2965, b3156b3708 is a homolog having said activity and being derived from Enterobacteriales. In one embodiment, the homolog of the b0146, b0342, b0523, b0598, b0644, b0760, b1046, b1095, b1136, b1399, b1410, b1556, b1704, b1980, b2223, b2240, b2284, b2965, b3156b3708 is a homolog having said activity and being derived from Enterobacteriaceae. In one embodiment, the homolog of the b0146, b0342, b0523, b0598, b0644, b0760, b1046, b1095, b1136, b1399, b1410, b1556, b1704, b1980, b2223, b2240, b2284, b2965, b3156 b3708 is homolog having said activity and being derived from *Escherichia*, preferably from *Escherichia coli*.

In one embodiment, the homolog of the YCR012W, YDR035W, YDR497W, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from an eukaryotic. In one embodiment, the homolog of the YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from Fungi. In one embodiment, the homolog of the YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from Ascomyceta. In one embodiment, the homolog of the YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from *Saccharomycotina*. In one embodiment, the homolog of the YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from *Saccharomycetes*. In one embodiment, the homolog of the YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from *Saccharomycetales*. In one embodiment, the homolog of the YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from Saccharomycetaceae. In one embodiment, the homolog of the YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C or YPR035W is a homolog having said activity and being derived from *Saccharomycetes*.

for the disclosure of this paragraph see paragraph [0038.0.0.0] above.

In accordance with the invention, a protein or polypeptide has the "activity of an protein as shown in table II, application no. 20, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 20, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 20, column 3, or which has at least 10% of the original enzymatic activity, preferably 20%, particularly preferably 30%, most particularly preferably 40% in comparison to a protein as shown in table II, application no. 20, column 3 of *Saccharomyces cerevisiae*.

for the disclosure of the paragraphs [0040.0.0.19] to [0047.0.0.19] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 20, column 3 its biochemical or genetical causes and the increased amount of the fine chemical.

for the disclosure of the paragraphs [0049.0.0.19] to [0051.0.0.19] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 20, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modifiy the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.19] to [0058.0.0.19] see paragraphs [0053.0.0.0] to [0058.0.0.0] above.

In case the activity of the *Escherichia coli* protein b0146 or its homologs, e.g. a "sugar fermentation stimulation protein" is increased advantageously in an organelle such as a plastid or mitochondria, preferably, in one embodiment an increase of the fine chemical, preferably of starch and/or cellulose in free or bound form between 39% and 73% or more is conferred.

In case the activity of the *Escherichia coli* protein b0342 or its homologs, e.g. a "thiogalactoside acetyltransferase" is increased advantageously in an organelle such as a plastid or mitochondria, preferably, in one embodiment an increase of the fine chemical, preferably of starch and/or cellulose in free or bound form between 34% and 69% or more is conferred.

In case the activity of the *Escherichia coli* protein b0523 or its homologs, e.g. a "phosphoribosylaminoimidazole carboxylase=AIR carboxylase, catalytic subunit" is increased advantageously in an organelle such as a plastid or mitochondria, preferably, in one embodiment an increase of the fine chemical, preferably of starch and/or cellulose in free or bound form between 49% and 78% or more is conferred.

In case the activity of the *Escherichia coli* protein b0598 or its homologs, e.g. a "carbon starvation protein" is increased advantageously in an organelle such as a plastid or mitochondria, preferably, in one embodiment an increase of the fine chemical, preferably of glucose in free or bound form between 58% and 104% or more is conferred.

In case the activity of the *Escherichia coli* protein b0644 or its homologs, e.g. a "uncharacterized protein" is increased advantageously in an organelle such as a plastid or mitochondria, preferably, in one embodiment an increase of the fine chemical, preferably of starch and/or cellulose in free or bound form between 37% and 66% or more is conferred.

In case the activity of the *Escherichia coli* protein b0760 or its homologs, e.g. a "ATP-binding component of molybdate transport system" is increased advantageously in an organelle such as a plastid or mitochondria, preferably, in one embodiment an increase of the fine chemical, preferably of glucose in free or bound form between 97% and 352% or more is conferred.

In case the activity of the *Escherichia coli* protein b1046 or its homologs, e.g. a "putative synthase with phospholipase D/nuclease domain" is increased advantageously in an organelle such as a plastid or mitochondria, preferably, in one embodiment an increase of the fine chemical, preferably of starch and/or cellulose in free or bound form between 31% and 82% or more is conferred.

In case the activity of the *Escherichia coli* protein b1095 or its homologs, e.g. a "3-oxoacyl-[acyl-carrier-protein] synthase II" is increased advantageously in an organelle such as a plastid or mitochondria, preferably, in one embodiment an increase of the fine chemical, preferably of fructose in free or bound form between 113% and 478% or more is conferred.

In case the activity of the *Escherichia coli* protein b1095 or its homologs, e.g. a "3-oxoacyl-[acyl-carrier-protein] synthase II" is increased advantageously in an organelle such as a plastid or mitochondria, preferably, in one embodiment an increase of the fine chemical, preferably of myo-inositol in free or bound form between 92% and 219% or more is conferred.

In case the activity of the *Escherichia coli* protein b1095 or its homologs, e.g. a "3-oxoacyl-[acyl-carrier-protein] synthase II" is increased advantageously in an organelle such as a plastid or mitochondria, preferably, in one embodiment an increase of the fine chemical, preferably of glucose in free or bound form between 72% and 358% or more is conferred.

In case the activity of the *Escherichia coli* protein b1095 or its homologs, e.g. a "3-oxoacyl-[acyl-carrier-protein] synthase II" is increased advantageously in an organelle such as a plastid or mitochondria, preferably, in one embodiment an increase of the fine chemical, preferably of glucose in free or bound form between 72% and 358% or more and/or of myo-inositol in free or bound form between 92% and 219% or more and/or of fructose in free or bound form between 113% and 478% or more is conferred.

In case the activity of the *Escherichia coli* protein b1136 or its homologs, e.g. a "isocitrate dehydrogenase (NADP)" is increased advantageously in an organelle such as a plastid or mitochondria, preferably, in one embodiment an increase of the fine chemical, preferably of starch and/or cellulose in free or bound form between 31% and 72% or more is conferred.

In case the activity of the *Escherichia coli* protein b1399 or its homologs, e.g. a "phenylacetic acid degradation operon negative regulatory protein paaX" is increased advantageously in an organelle such as a plastid or mitochondria, preferably, in one embodiment an increase of the fine chemical, preferably of myo-inositol in free or bound form between 27% and 108% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased advantageously in an organelle such as a plastid or mitochondria, preferably, in one embodiment an increase of the fine chemical, preferably of glucose in free or bound form between 57% and 377% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased advantageously in an organelle such as a plastid or mitochondria, preferably, in one embodiment an increase of the fine chemical, preferably of myo-inositol in free or bound form between 34% and 49% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased advantageously in an organelle such as a plastid or mitochondria, preferably, in one embodiment an increase of the fine chemical, preferably of fructose in free or bound form between 87% and 427% or more is conferred.

In case the activity of the *Escherichia coli* protein b1410 or its homologs, e.g. a "putative methylase with S-adenosyl-L-methionine-dependent methyltransferase domain and alpha/beta-hydrolase domain" is increased advantageously in an organelle such as a plastid or mitochondria, preferably, in one embodiment an increase of the fine chemical, preferably of glucose in free or bound form between 57% and 377% or more and/or of myo-inositol in free or bound form between 34% and 49% or more and/or of fructose in free or bound form between 87% and 427% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of sucrose in free or bound form between 31% and 37% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of myo-inositol between 25% and 207% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of raffinose in free or bound form between 85% and 309% or more is conferred.

In case the activity of the *Escherichia coli* protein b1556 or its homologs, e.g. a "Qin prophage" is increased advantageously in an organelle such as a plastid or mitochondria, preferably, in one embodiment an increase of the fine chemical, preferably of sucrose in free or bound form between 31% and 37% or more and/or of myo-inositol between 25% and 207% or more and/or of raffinose in free or bound form between 85% and 309% or more is conferred.

In case the activity of the *Escherichia coli* protein b1704 or its homologs, e.g. a "3deoxy-D-arabinoheptulosonate-7-phosphate synthase (DAHP synthetase), tryptophanrepressible" is increased advantageously in an organelle such as a plastid or mitochondria, preferably, in one embodiment an increase of the fine chemical, preferably of starch and/or cellulose in free or bound form between 24% and 101% or more is conferred.

In case the activity of the *Escherichia coli* protein b1980 or its homologs, e.g. a "uncharacterized transport protein" is increased advantageously in an organelle such as a plastid or mitochondria, preferably, in one embodiment an increase of the fine chemical, preferably of raffinose in free or bound form between 67% and 101% or more is conferred.

In case the activity of the *Escherichia coli* protein b2223 or its homologs, e.g. a "short chain fatty acid transporter" is increased advantageously in an organelle such as a plastid or mitochondria, preferably, in one embodiment an increase of the fine chemical, preferably of myo-inositol in free or bound form between 26% and 332% or more is conferred.

In case the activity of the *Escherichia coli* protein b2223 or its homologs, e.g. a "short chain fatty acid transporter" is increased advantageously in an organelle such as a plastid or mitochondria, preferably, in one embodiment an increase of the fine chemical, preferably of raffinose in free or bound form between 72% and 517% or more is conferred.

In case the activity of the *Escherichia coli* protein b2223 or its homologs, e.g. a "short chain fatty acid transporter" is increased advantageously in an organelle such as a plastid or mitochondria, preferably, in one embodiment an increase of the fine chemical, preferably of glucose in free or bound form between 60% and 520% or more is conferred.

In case the activity of the *Escherichia coli* protein b2223 or its homologs, e.g. a "short chain fatty acid transporter" is increased advantageously in an organelle such as a plastid or mitochondria, preferably, in one embodiment an increase of the fine chemical, preferably of myo-inositol in free or bound form between 26% and 332% or more and/or of raffinose in free or bound form between 72% and 517% or more and/or of glucose in free or bound form between 60% and 520% or more is conferred.

In case the activity of the *Escherichia coli* protein b2284 or its homologs, e.g. a "NADH2 dehydrogenase" is increased advantageously in an organelle such as a plastid or mitochondria, preferably, in one embodiment an increase of the fine chemical, preferably of starch and/or cellulose in free or bound form between 66% and 68% or more is conferred.

In case the activity of the *Escherichia coli* protein b2240 or its homologs, e.g. a "glycerol-3-phosphate transport protein" is increased advantageously in an organelle such as a plastid or mitochondria, preferably, in one embodiment an increase of the fine chemical, preferably of starch and/or cellulose in free or bound form between 31% and 90% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of sucrose in free or bound form between 30% and 329% or more is conferred.

In case the activity of the *Escherichia coli* protein b3156 or its homologs, e.g. a "putative acyl-CoA N-acyltransferase" is increased advantageously in an organelle such as a plastid or mitochondria, preferably, in one embodiment an increase of the fine chemical, preferably of fructose in free or bound form between 114% and 197% or more is conferred.

In case the activity of the *Escherichia coli* protein b3708 or its homologs, e.g. a "tryptophan deaminase, PLP-dependent" is increased advantageously in an organelle such as a plastid or mitochondria, preferably, in one embodiment an increase of the fine chemical, preferably of raffinose in free or bound form between 61% and 249% or more is conferred.

In case the activity of the *Saccharomyces cerevisiae* protein YCR012W or its homologs, e.g. a "3-phosphoglycerate kinase" is increased advantageously in an organelle such as a plastid or mitochondria, preferably, in one embodiment an increase of the fine chemical, preferably of raffinose between 57% and 281% or more is conferred.

In case the activity of the *Saccharomyces cerevisiae* protein YDR035W or its homologs, e.g. a "3-deoxy-D-arabino-heptulosonate 7-phosphate (DAHP) synthase" is increased advantageously in an organelle such as a plastid or mitochondria, preferably, in one embodiment the increase of the fine chemical, preferably of raffinose between 71% and 440% or more is conferred.

In case the activity of the *Saccharomyces cerevisiae* protein YDR497C or its homologs, e.g. a "myo-inositol transporter" is increased, preferably, in one embodiment the increase of the fine chemical, preferably of fructose between 106% and 527% or more is conferred.

In case the activity of the *Saccharomyces cerevisiae* protein YDR497C or its homologs, e.g. a "myo-inositol transporter" is increased advantageously in an organelle such as a plastid or mitochondria, preferably, in one embodiment the increase of the fine chemical, preferably of myo-inositol between 26% and 29% or more is conferred.

In case the activity of the *Saccharomyces cerevisiae* protein YDR497C or its homologs, e.g. a "myo-inositol transporter" is increased advantageously in an organelle such as a plastid or mitochondria, preferably, in one embodiment the increase of the fine chemical, preferably of fructose between 106% and 527% or more and of myo-inositol between 26% and 29% or more is conferred.

In case the activity of the *Saccharomyces cerevisiae* protein YER063W or its homologs, e.g. a "uncharacterized protein" is increased advantageously in an organelle such as a plastid or mitochondria, preferably, in one embodiment an increase of the fine chemical, preferably of fructose between 68% and 80% or more is conferred.

In case the activity of the *Saccharomyces cerevisiae* protein YGL065C or its homologs, e.g. a "ALG2 protein precursor" is increased advantageously in an organelle such as a plastid or mitochondria, preferably, in one embodiment the increase of the fine chemical, preferably of myo-inositol between 12% and 23% or more is conferred.

In case the activity of the *Saccharomyces cerevisiae* protein YGL065C or its homologs, e.g. a "ALG2 protein precursor" is increased, preferably, in one embodiment the increase of the fine chemical, preferably of starch and/or cellulose between 40% and 47% or more is conferred.

In case the activity of the *Saccharomyces cerevisiae* protein YGL065C or its homologs, e.g. a "ALG2 protein precursor" is increased, preferably, in one embodiment the increase of the fine chemical, preferably of myo-inositol between 12% and 23% or more and of starch and/or cellulose between 40% and 47% or more is conferred.

In case the activity of the *Saccharomyces cerevisiae* protein YGR255C or its homologs, e.g. a "putative flavin-dependent monooxygenase, involved in ubiquinone (Coenzyme Q) biosynthesis" is increased advantageously in an organelle such as a plastid or mitochondria, preferably, in one embodiment the increase of the fine chemical, preferably of glucose between 82% and 394% or more is conferred.

In case the activity of the *Saccharomyces cerevisiae* protein YGR255C or its homologs, e.g. a "putative flavin-dependent monooxygenase, involved in ubiquinone (Coenzyme Q) biosynthesis" is increased advantageously in an organelle such as a plastid or mitochondria, preferably, in one embodiment the increase of the fine chemical, preferably of raffinose between 72% and 151% or more is conferred.

In case the activity of the *Saccaromyces cerevisiae* protein YGR255C or its homologs, e.g. a "putative flavin-dependent monooxygenase, involved in ubiquinone (Coenzyme Q) biosynthesis" is increased advantageously in an organelle such as a plastid or mitochondria, preferably, in one embodiment the increase of the fine chemical, preferably of glucose between 82% and 394% or more and of raffinose between 72% and 151% or more is conferred.

In case the activity of the *Saccaromyces cerevisiae* protein YGR262C or its homologs, e.g. a "protein involved in bud-site selection" is increased advantageously in an organelle such as a plastid or mitochondria, preferably, in one embodiment the increase of the fine chemical, preferably of fructose between 58% and 106% or more is conferred.

In case the activity of the *Saccaromyces cerevisiae* protein YGR262C or its homologs, e.g. a "protein involved in bud-site selection" is increased, preferably, in one embodiment the increase of the fine chemical, preferably of glucose between 65% and 77% or more is conferred.

In case the activity of the *Saccaromyces cerevisiae* protein YGR262C or its homologs, e.g. a "protein involved in bud-site selection" is increased, preferably, in one embodiment the increase of the fine chemical, preferably of fructose between 58% and 106% or more and of glucose between 65% and 77% or more is conferred.

In case the activity of the *Saccaromyces cerevisiae* protein YHR204W or its homologs, e.g. a "mannosidase like protein" is increased advantageously in an organelle such as a plastid or mitochondria, preferably, in one embodiment the increase of the fine chemical, preferably of myo-inositol between 30% and 52% or more is conferred.

In case the activity of the *Saccaromyces cerevisiae* protein YIR020W-A or its homologs, e.g. a "protein of unknown function" is increased advantageously in an organelle such as a plastid or mitochondria, preferably, in one embodiment the increase of the fine chemical, preferably of fructose between 84% and 107% or more is conferred.

In case the activity of the *Saccaromyces cerevisiae* protein YIR020W-A or its homologs, e.g. a "protein of unknown function" is increased advantageously in an organelle such as a plastid or mitochondria, preferably, in one embodiment the increase of the fine chemical, preferably of glucose between 46% and 87% or more is conferred.

In case the activity of the *Saccaromyces cerevisiae* protein YIR020W-A or its homologs, e.g. a "protein of unknown function" is increased advantageously in an organelle such as a plastid or mitochondria, preferably, in one embodiment the increase of the fine chemical, preferably of fructose between 84% and 107% or more and of glucose between 46% and 87% or more is conferred.

In case the activity of the *Saccaromyces cerevisiae* protein YJL139C or its homologs, e.g. a "mannosyltransferase of the KTR1 family, involved in protein N-glycosylation" is increased advantageously in an organelle such as a plastid or mitochondria, preferably, in one embodiment the increase of the fine chemical, preferably of myo-inositol between 27% and 135% or more is conferred.

In case the activity of the *Saccaromyces cerevisiae* protein YJL139C or its homologs, e.g. a "mannosyltransferase of the KTR1 family, involved in protein N-glycosylation" is increased advantageously in an organelle such as a plastid or mitochondria, preferably, in one embodiment the increase of the fine chemical, preferably of glucose between 64% and 157% or more is conferred.

In case the activity of the *Saccaromyces cerevisiae* protein YJL139C or its homologs, e.g. a "mannosyltransferase of the KTR1 family, involved in protein N-glycosylation" is increased advantageously in an organelle such as a plastid or mitochondria, preferably, in one embodiment the increase of the fine chemical, preferably of myo-inositol between 27% and 135% or more and of glucose between 64% and 157% or more is conferred.

In case the activity of the *Saccaromyces cerevisiae* protein YKR043C or its homologs, e.g. a uphosphoglycerate mutase like protein" is increased, preferably, in one embodiment the increase of the fine chemical, preferably of UDP-glucose between 66% and 72% or more is conferred.

In case the activity of the *Saccaromyces cerevisiae* protein YLL033W or its homologs, e.g. a "uncharacterized protein" is increased advantageously in an organelle such as a plastid or mitochondria, preferably, in one embodiment the increase of the fine chemical, preferably of raffinose between 81% and 82% or more is conferred.

In case the activity of the *Saccaromyces cerevisiae* protein YLR153C or its homologs, e.g. a "acetyl CoA synthetase" is increased advantageously in an organelle such as a plastid or mitochondria, preferably, in one embodiment the increase of the fine chemical, preferably of glucose between 64% and 306% or more is conferred.

In case the activity of the *Saccaromyces cerevisiae* protein YLR174W or its homologs, e.g. a "NADP-dependent isocitrate dehydrogenase" is increased advantageously in an organelle such as a plastid or mitochondria, preferably, in one embodiment the increase of the fine chemical, preferably of raffinose between 61% and 86% or more is conferred.

In case the activity of the *Saccaromyces cerevisiae* protein YLR174W or its homologs, e.g. a "NADP-dependent isocitrate dehydrogenase" is increased advantageously in an organelle such as a plastid or mitochondria, preferably, in one embodiment the increase of the fine chemical, preferably of myo-inositol between 25% and 32% or more is conferred.

In case the activity of the *Saccaromyces cerevisiae* protein YLR174W or its homologs, e.g. a "NADP-dependent isocitrate dehydrogenase" is increased advantageously in an organelle such as a plastid or mitochondria, preferably, in one embodiment the increase of the fine chemical, preferably of raffinose between 61% and 86% or more and of myo-inositol between 25% and 32% or more is conferred.

In case the activity of the *Saccaromyces cerevisiae* protein YNL022C or its homologs, e.g. a "uncharacterized protein" is increased advantageously in an organelle such as a plastid or mitochondria, preferably, in one embodiment the increase of the fine chemical, preferably of raffinose between 59% and 62% or more is conferred.

In case the activity of the *Saccaromyces cerevisiae* protein YNL241C or its homologs, e.g. a "glucose-6-phosphate dehydrogenase" is increased advantageously in an organelle such as a plastid or mitochondria, preferably, in one embodiment the increase of the fine chemical, preferably of glucose between 199% and 430% or more is conferred.

In case the activity of the *Saccaromyces cerevisiae* protein YNL241C or its homologs, e.g. a "glucose-6-phosphate dehydrogenase" is increased advantageously in an organelle such as a plastid or mitochondria, preferably, in one embodiment the increase of the fine chemical, preferably of fructose between 86% and 364% or more is conferred.

In case the activity of the *Saccaromyces cerevisiae* protein YNL241C or its homologs, e.g. a "glucose-6-phosphate dehydrogenase" is increased advantageously in an organelle such as a plastid or mitochondria, preferably, in one embodiment the increase of the fine chemical, preferably of of glucose between 199% and 430% or more and of fructose between 86% and 364% or more is conferred.

In case the activity of the *Saccaromyces cerevisiae* protein YNR012W or its homologs, e.g. a "uridine kinase" is increased advantageously in an organelle such as a plastid or mitochondria, preferably, in one embodiment the increase of the fine chemical, preferably of myo-inositol between 31% and 64% or more is conferred.

In case the activity of the *Saccaromyces cerevisiae* protein YOR353C or its homologs, e.g. a "protein required for cell morphogenesis and cell separation after mitosis; Sog2p" is increased advantageously in an organelle such as a plastid or mitochondria, preferably, in one embodiment the increase of the fine chemical, preferably of fructose between 78% and 287% or more is conferred.

In case the activity of the *Saccaromyces cerevisiae* protein YOR353C or its homologs, e.g. a "protein required for cell morphogenesis and cell separation after mitosis; Sog2p" is increased advantageously in an organelle such as a plastid or mitochondria, preferably, in one embodiment the increase of the fine chemical, preferably of glucose between 66% and 141% or more is conferred.

In case the activity of the *Saccaromyces cerevisiae* protein YOR353C or its homologs, e.g. a "protein required for cell morphogenesis and cell separation after mitosis; Sog2p" is increased advantageously in an organelle such as a plastid or mitochondria, preferably, in one embodiment the increase of the fine chemical, preferably of fructose between 78% and 287% or more and of glucose between 66% and 141% or more is conferred.

In case the activity of the *Saccaromyces cerevisiae* protein YPL138C or its homologs, e.g. a "compass (complex proteins associated with Set1p) component" is increased advantageously in an organelle such as a plastid or mitochondria, preferably, in one embodiment the increase of the fine chemical, preferably of starch and/or cellulose between 31% and 114% or more is conferred.

In case the activity of the *Saccaromyces cerevisiae* protein YPR035W or its homologs, e.g. a "glutamine synthetase" is increased advantageously in an organelle such as a plastid or mitochondria, preferably, in one embodiment the increase of the fine chemical, preferably of myo-inositol between 27% and 365% or more is conferred. In case the activity of the *Saccaromyces cerevisiae* protein YPR035W or its homologs, e.g. a "glutamine synthetase" is increased advantageously in an organelle such as a plastid or mitochondria, preferably, in one embodiment the increase of the fine chemical, preferably of raffinose between 102% and 125% or more is conferred.

In case the activity of the *Saccaromyces cerevisiae* protein YPR035W or its homologs, e.g. a "glutamine synthetase" is increased advantageously in an organelle such as a plastid or mitochondria, preferably, in one embodiment the increase of the fine chemical, preferably of myo-inositol between 27% and 365% or more and of raffinose between 102% and 125% or more is conferred.

In case the activity of the *Escherichia coli* proteins b0146, b0342, b0523, b0598, b0644, b0760, b1046, b1095, b1136, b1399, b1410, b1556, b1704, b1980, b2223, b2240, b2284, b2965, b3156 b3708 or their homologs, are increased advantageously in an organelle such as a plastid or mitochondria, preferably an increase of the fine chemical such as starch and/cellulose, glucose, fructose, myoinositol, sucrose, raffinose or mixtures thereof in free or bound forms conferred. In case the activity of the *Saccaromyces cerevisiae* protein YCR012W, YDR035W, YDR497C, YER063W, YGL065C, YGR255C, YGR262C, YHR204W, YIR020W-A, YJL139C, YKR043C, YLL033W, YLR153C, YLR174W, YNL022C, YNL241C, YNR012W, YOR353C, YPL138C and/or YPR035W or their homologs, are increased advantageously in an organelle such as a plastid or mitochondria, preferably an increase of the fine chemical such as starch and/cellulose, glucose, UDP-glucose, fructose, myo-inositol, sucrose, raffinose or mixtures thereof in free or bound form is conferred.

for the disclosure of the paragraphs [0061.0.0.19] and [0062.0.0.19] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 20, column 7 or of the polypeptide as shown in the amino acid sequences as disclosed in table II, application no. 20, columns 5 and 7 or the functional homologues thereof as described herein, or is encoded by the nucleic acid molecule characterized herein or the nucleic acid molecule according to the invention, for example by the nucleic acid molecule as shown in table I, application no. 20, columns 5 and 7 or its herein described functional homologues and has the herein mentioned activity.

/ for the disclosure of the paragraphs [0065.0.0.19] and [0066.0.0.19] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 20, columns 5 and 7 or its homologs activity having herein-mentioned starch and/cellulose, glucose, UDP-glucose, fructose, myo-inositol, sucrose and/or raffinose increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 20, columns 5 and 7, e.g. a nucleic acid sequence encoding a polypeptide having the activity of a protein as indicated in table II, application no. 20, columns 5 and 7 or its homologs activity or of a mRNA encoding the polypeptide of the present invention having herein-mentioned starch and/cellulose, glucose, UDP-glucose, fructose, myo-inositol, sucrose and/or raffinose increasing activity; and/or c) increasing the specific activity of a protein conferring the increased expression of a protein encoded by the nucleic acid molecule of the invention or of the polypeptide of the present invention having herein-mentioned starch and/cellulose, glucose, UDP-glucose, fructose, myo-inositol, sucrose and/or raffinose increasing activity, e.g. of a polypeptide having the activity of a protein as indicated in table II, application no. 20, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned starch and/cellulose, glucose, UDP-glucose, fructose, myo-inositol, sucrose and/or raffinose increasing activity, e.g. of a polypeptide having the activity of a protein as indicated in table II, application no. 20, columns 5 and 7 or its homologs activity; and/or e) stimulating activity of a protein conferring the increased expression of a protein encoded by the nucleic acid molecule of the present invention or a polypeptide of the present invention having herein-mentioned starch and/cellulose, glucose, UDP-glucose, fructose, myo-inositol, sucrose and/or raffinose increasing activity, e.g. of a polypeptide having the activity of a protein as indicated in table II, application no. 20, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned starch and/cellulose, glucose, UDP-glucose, fructose, myo-inositol, sucrose and/or raffinose increasing activity, e.g. of a polypeptide having the activity of a protein as indicated in table II, application no. 20, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned starch and/cellulose, glucose, UDP-glucose, fructose, myo-inositol, sucrose and/or raffinose increasing activity, e.g. of a polypeptide having the activity of a protein as indicated in table II, application no. 20, columns 5 and 7 or its homologs activity; and/or h) increasing the expression of the endogenous gene encoding the polypeptide of the invention, e.g. a polypeptide having the activity of a protein as indicated in table II, application no. 20, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned starch and/cellulose, glucose, UDP-glucose, fructose, myo-inositol, sucrose and/or raffinose increasing activity, e.g. of polypeptide having the activity of a protein as indicated in table II, application no. 20, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned starch and/cellulose, glucose, UDP-glucose, fructose, myo-inositol, sucrose and/or raffinose increasing activity, e.g. of a polypeptide having the activity of a protein as indicated in table II, application no. 20, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned starch and/cellulose, glucose, UDP-glucose, fructose, myo-inositol, sucrose and/or raffinose increasing activity, e.g. of a polypeptide having the activity of a protein as indicated in table II, application no. 20, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 20, column 3 or its homologs. Preferably the increase of the fine chemical takes place in plastids.

for the disclosure of the paragraphs [0069.0.0.19] to [0079.0.0.19] see paragraphs [0069.0.0.0] to [0079.0.0.0] above.

The activation of an endogenous polypeptide having above-mentioned activity, e.g. having the activity of a protein as shown in table II, application no. 20, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 20, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 20, column 3. The expression of the chimeric transcription factor in a organism, in particular in a plant, leads to a specific expression of the protein as shown in table II, application no. 20, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.19] to [0084.0.0.19] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. starch and/cellulose, glucose, UDP-glucose, fructose, myo-inositol, sucrose or raffinose in free or bound form and mixtures thereof.

for the disclosure of this paragraph see paragraph [0086.0.0.0] above.

By influencing the metabolism thus, it is possible to produce, in the process according to the invention, further advantageous compounds. Examples of such compounds are, in addition to starch and/cellulose, glucose, UDP-glucose, fructose, myo-inositol, sucrose and/or raffinose compounds such as other sugars such as galactose, mannose, xylose, maltose or cellobiose, sugar alcohols such as ribitol, amino sugars such as α-D-glucosamine or α-D-N-acetylglucosamine and/or sugar acids such as glucoronic acid, vitamins, amino acids or fatty acids.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 20, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, in addition other free or/and bound sugars such as galactose, mannose, xylose, maltose or cellobiose or mixtures thereof.

The organism such as microorganisms or plants or the recovered, and if desired isolated, respective fine chemical can then be processed further directly into foodstuffs or animal feeds or for other applications in nutrition or medicine or cosmetics, for example according to the disclosures made in U.S. Pat. No. 6,669,962 (Starch microcapsules for delivery of active agents); US 20050042737 (Starch process); US 20050054071 (Enzymes for starch processing); US 20050091716 (Novel plants and processes for obtaining them); U.S. Pat. No. 5,096,594 and U.S. Pat. No. 5,482,631 discloses a method of purifying cyclitols; U.S. Pat. No. 4,997,489 discloses soaking almond hulls in water to obtain a syrup containing fructose, glucose, inositol, and sorbitol; U.S. Pat. No. 5,296,364 discloses a microbial method for producing inositol; U.S. Pat. No. 4,734,402; U.S. Pat. No. 4,788,065; U.S. Pat. No. 6,465,037 and U.S. Pat. No. 6,355,295 relates to soy food ingredient based on carbohydrates, U.S. Pat. No. 6,653,451; US 20040128713: pertains to soybean plants having in their seeds significantly lower contents of raffinose, stachyose and phytic acid and significantly higher contents of sucrose and inorganic phosphate; US 20050008713 discloses compositions of plant carbohydrates for dietary supplements and nutritional support; which are expressly incorporated herein by reference. The fermentation broth, fermentation products, plants or plant products can be treated and processed as described in above mentioned applications or by other methods known to the person skilled in the art and described herein below.

In the method for producing carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose and/or glucose, derivatives preferably anhydroglucose and/or UDP-glucose according to the invention, the cultivation step of the genetically modified organisms, also referred to as transgenic organisms hereinbelow, is preferably followed by harvesting said organisms and isolating the respective carbohydrate(s) from said organisms.

The organisms are harvested in a manner known per se and appropriate for the particular organism. Microorganisms such as bacteria, mosses, yeasts and fungi or plant cells which are cultured in liquid media by fermentation may be removed, for example, by centrifugation, decanting or filtration. Plants are grown on solid media in a manner known per se and harvested accordingly.

Carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose, derivatives preferably anhydroglucose and/or UDP-glucose are isolated from the harvested biomass in a manner known per se, for example by extraction and, where appropriate, further chemical or physical purification processes such as, for example, chemical and/or enzymatical degradation, precipitation methods, crystallography, thermal separation methods such as rectification methods or physical separation methods such as, for example, chromatography.

Products of these different work-up procedures are carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose, derivatives preferably anhydroglucose and/or UDP-glucose comprising compositions, e.g. compostions comprising carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose, derivatives preferably anhydroglucose and/or UDP-glucose which still comprise fermentation broth, plant particles and/or cell components in different amounts, advantageously in the range of from 0 to 99% by weight, preferably below 80% by weight, especially preferably between 50%, 40%, 30%, 20%, 20%, 10%, 5%, 3%, 2%, 1%, 05%, 0.1%, 0.01% and 0% by weight resp.

In one embodiment, preferred plants include, but are not limited to: sugar beet, sugar cane, soybeans, wheat, corn, rice and/or potato (*Solanum tuberosum*).

for the disclosure of the paragraphs [0090.0.0.19] to [0097.0.0.19] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 20, columns 5 and 7 or a derivative thereof, or
b) a genetic regulatory element, for example a promoter, which is functionally linked to the nucleic acid sequence as shown table I, application no. 20, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 20, columns 5 and 7 joined to a nucleic acid sequence encoding a transit peptide, or a targeting nucleic acid sequence which directs the nucleic acid sequences disclosed in table I, application no. 20, columns 5 and 7 to the organelle preferentially the plastids. Altenatively the inventive nucleic acids sequences consist advantageously of the nucleic acid sequences as depicted in the sequence protocol and disclosed in table I, application no. 20, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose starch and/cellulose, glucose, UDP-glucose, fructose, myoinositol, sucrose and/or raffinose content is modified advantageously owing to the nucleic acid molecule of the present invention expressed. This is important for plant breeders since, for example, the nutritional value of plants for animals and humans is dependent on the abovementioned carbohydrates and the general amount of saccharides such as starch and/cellulose, glucose, UDP-glucose, fructose, myo-inositol, sucrose and/or raffinose and the general amount of starch and/cellulose, glucose, UDP-glucose, fructose, myo-inositol, sucrose and/or raffinose for example as energy source in food and feed. After the activity of the protein as shown in table II, application no. 20, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.19] to [0110.0.0.19] see paragraphs [0102.0.0.0] to [0110.0.0.0] above.

In a preferred embodiment, the fine chemical (starch and/cellulose, glucose, UDP-glucose, fructose, myo-inositol, sucrose and/or raffinose) is produced in accordance with the invention and, if desired, is isolated. The production of further sugars such as such as galactose, mannose, xylose, maltose or cellobiose or mixtures thereof or mixtures of other sugars by the process according to the invention is advantageous. It may be advantageous to increase the pool of free sugars such as starch and/cellulose, glucose, UDP-glucose, fructose, myo-inositol, sucrose and/or raffinose and other sugars as aforementioned in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example another gene encoding a protein of the carbohydrate metabolism such as starch and/cellulose, glucose, UDP-glucose, fructose, myo-inositol, sucrose and/or raffinose biosynthesis, or a compound, which functions as a sink for the desired starch and/cellulose, glucose, UDP-glucose, fructose, myo-inositol, sucrose and/or raffinose in the organism is useful to increase the production of the respective fine chemical.

In a preferred embodiment, the respective fine chemical is produced in accordance with the invention and, if desired, is isolated. The production of further sugars other than starch and/cellulose, glucose, UDP-glucose, fructose, myo-inositol, sucrose and/or raffinose or compounds for which the respective fine chemicals are a biosynthesis precursor compounds, e.g. organic acids such as pyruvic acid, oxaloacetic acid, citric acid, cis-aconic acid, iso-citric acid, alpha-ketoglutaric acid, succinic acid, fumaric acid or malic acid, amino acids, fatty acids or mixtures thereof and/or other chemical compounds derived from sugars or mixtures with other carbohydrates such as sugars like galactose, mannose, xylose, maltose or cellobiose, in particular of galactose, mannose, xylose, maltose or cellobiose or mixtures thereof, by the process according to the invention is advantageous.

In the case of the fermentation of microorganisms, the abovementioned carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose, and/or glucose derivatives such as UDP-glucose or anhydroglucose may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical or the carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose, and/or glucose derivatives such as UDP-glucose or anhydroglucose compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fine chemical such as starch and/cellulose, glucose, UDP-glucose, fructose, myo-inositol, sucrose and/or raffinose synthesized in the process according to the invention can advantageously be marketed directly without there being any need for the fine chemical synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

However, the respective fine chemical produced in the process according to the invention can also be isolated from the organisms, advantageously plants, (in the form of carbohydrate containing aqueous solutions, containing starch and/cellulose, glucose, UDP-glucose, fructose, myo-inositol, sucrose and/or raffinose. The respective fine chemical produced by this process can be obtained by harvesting the organisms, either from the medium in which they grow, or from the field. This can be done via pressing, crushing or extraction of the plant parts. The crushing process must break up the hard nodes of the sugar cane and flatten the stems. In the event sugar beets are used for the process the plant is sliced and the sugar is extracted with hot water. The sugar containing juice is collected and filtered. Afterwards the juice is treated with chemicals to remove impurities. Thereafter the juice is boiled to drive off excess water. The sugar is then extracted by controlled crystallisation. The sugar crystals are removed for example by a centrifuge and the liquid recycled in the crystalliser stages. To increase the efficiency of extraction it is beneficial to clean, to temper and if necessary to hull and to flake the plant material. In the case of microorganisms, the latter are, after harvesting, for example extracted directly without further processing steps or else, after disruption, extracted via various methods with which the skilled worker is familiar.

Thereafter, the resulting products can be processed further.

Well-established approaches for the harvesting of cells include filtration, centrifugation and coagulation/flocculation as described herein.

Carbohydrates, preferably polysaccharides, more preferably starch and/or cellulose or their "analytes" such as anhydroglucose and/or monosaccharides, more preferably fructose, glucose and/or myo-inositol and/or trisaccharides, more preferably raffinose and/or disaccharides, more preferably sucrose can for example be analyzed advantageously via HPLC or GC separation methods and detected by MS oder MSMS methods. The unambiguous detection for the presence of carbohydrates, preferably polysaccharides, more preferably starch and/or cellulose or their analytes such as anhydroglucose and/or monosaccharides, more preferably fructose, glucose and/or myo-inositol and/or trisaccharides, more preferably raffinose and/or disaccharides, more preferably sucrose containing products can be obtained by analyzing recombinant organisms using analytical standard methods: GC, GC-MS, LC, LC-MSMS or TLC, as described on several occasions. The carbohydrates can be analized further in plant extracts by anion-exchange chromatography with pulsed amperometric detection (Cataldi et al., Anal Chem.; 72(16):3902-7, 2000), by enzymatic "BioAnalysis" using test kits from R-Biopharm and Roche or from Megazyme, Ireland.

Carbohydrates can for example be detected advantageously via HPLC with reversed phase columns. The unambiguous detection for the presence of carbohydrates products can be obtained by analyzing recombinant organisms using analytical standard methods like HPLC-MS or HPLC-MSMS.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 20, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 20, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table II, application no. 20, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 20, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 20, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 20, columns 5 and 7 by one or more nucleotides. In one embodiment, the nucleic acid molecule used in the process of the invention does not consist of the sequence indicated in table IA, application no. 20, columns 5 and 7. In one embodiment, the nucleic acid molecule used in the process of the invention is less than 100%, 99.999%, 99.99%, 99.9% or 99% identical to a sequence indicated in table IA, application no. 20, columns 5 and 7. In another embodiment, the nucleic acid molecule does not encode a polypeptide of a sequence indicated in table IIA, application no. 20, columns 5 and 7.

In one embodiment, the nucleic acid molecule used in the process of the invention distinguishes over the sequence indicated in table IB, application no. 20, columns 5 and 7, by one or more nucleotides. In one embodiment, the nucleic acid molecule used in the process of the invention does not consist of the sequence indicated in table IB, application no. 20, columns 5 and 7. In one embodiment, the nucleic acid molecule used in the process of the invention is less than 100%, 99.999%, 99.99%, 99.9% or 99% identical to a sequence indicated in table IB, application no. 20, columns 5 and 7. In another embodiment, the nucleic acid molecule does not encode a polypeptide of a sequence indicated in table IIB, application no. 20, columns 5 and 7.

In one embodiment, the nucleic acid molecule used in the process distinguishes over the sequence shown in table I, application no. 20, columns 5 and 7 by one or more nucleotides or does not consist of the sequence shown in table I, application no. 20, columns 5 and 7. In one embodiment, the nucleic acid molecule of the present invention is less than 100%, 99.999%, 99.99%, 99.9% or 99% identical to the sequence shown in table I, application no. 20, columns 5 and 7. In another embodiment, the nucleic acid molecule does not encode a polypeptide of the sequence shown in table II, application no. 20, columns 5 and 7.

for the disclosure of the paragraphs [0118.0.0.19] to [0120.0.0.19] see paragraphs [0118.0.0.0] to [0120.0.0.0] above.

Nucleic acid molecules with the sequence shown in table I, application no. 20, columns 5 and 7, nucleic acid molecules which are derived from the amino acid sequences shown in table II, application no. 20, columns 5 and 7 or from polypeptides comprising the consensus sequence shown in table IV, application no. 20, column 7, or their derivatives or homologues encoding polypeptides with the enzymatic or biological activity of a protein as shown in table II, application no. 20, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 20, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 20, column 3 and conferring the fine chemical increase by expression either in the cytsol or in an organelle such as a plastid or mitochondria or both, preferably in plastids.

for the disclosure of the paragraphs [0126.0.0.19] to [0133.0.0.19] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 20, columns 5 and 7 or the functional homologues thereof as described herein, preferably conferring above-mentioned activity, i.e. conferring the fine chemical increase after increasing its activity, e.g. after increasing the activity of a protein as shown in table II, application no. 20, column 3 by for example expression either in the cytsol or in an organelle such as a plastid or mitochondria or both, preferably in plastids.

for the disclosure of the paragraphs [0135.0.0.19] to [0140.0.0.19] see paragraphs [0135.0.0.0] to [0140.0.0.0] above.

Synthetic oligonucleotide primers for the amplification, e.g. as shown in table III, application no. 20, column 7, by means of polymerase chain reaction can be generated on the basis of a sequence shown herein, for example the sequence shown in table I, application no. 20, columns 5 and 7 or the sequences derived from table II, application no. 20, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 20, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 20, column 3 or further functional homologs of the polypeptide of the invention from other organisms.

for the disclosure of the paragraphs [0144.0.0.19] to [0151.0.0.19] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 20, columns 5 and 7, preferably of table IB, application no. 20, columns 5 and 7 under relaxed hybridization conditions and which code on expression for peptides having the starch and/cellulose, glucose, UDP-glucose, fructose, myo-inositol, sucrose and/or raffinose increasing activity.

for the disclosure of the paragraphs [0153.0.0.19] to [0159.0.0.19] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 20, columns 5 and 7, preferably shown in table IB, application no. 20, columns 5 and 7 is one which is sufficiently complementary to one of the nucleotide sequences shown in table I, application no. 20, columns 5 and 7, preferably shown in table IB, application no. 20, columns 5 and 7 such that it can hybridize to one of the nucleotide sequences shown in table I, application no. 20, columns 5 and 7, preferably shown in table IB, application no. 20, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 20, columns 5 and 7, preferably shown in table IB, application no. 20, columns 5 and 7, or a portion thereof and preferably has above mentioned activity, in particular having a fine chemical increasing activity after increasing the activity or an activity of a gene product as shown in table II, application no. 20, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 20, columns 5 and 7, preferably shown in table IB, application no. 20, columns 5 and 7, or a portion thereof and encodes a protein having above-mentioned activity, e.g. conferring of a starch and/cellulose, glucose, UDP-glucose, fructose, myo-inositol, sucrose and/or raffinose increase by for example expression either in the cytsol or in an organelle such as a plastid or mitochondria or both, preferably in plastids, and optionally, the activity of a protein as shown in table II, application no. 20, column 3.

Moreover, the nucleic acid molecule of the invention can comprise only a portion of the coding region of one of the sequences shown in table I, application no. 20, columns 5 and 7, preferably shown in table IB, application no. 20, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 20, columns 5 and 7, an anti-sense sequence of one of the sequences, e.g., set forth in table I, application no. 20, columns 5 and 7, preferably shown in table IB, application no. 20, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table II, application no. 20, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 20, columns 5 and 7 such that the protein or portion thereof maintains the ability to participate in the fine chemical production, in particular a starch and/cellulose, glucose, UDP-glucose, fructose, myo-inositol, sucrose and/or raffinose increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 20, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 20, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.19] and [0169.0.0.19] see paragraphs [0168.0.0.0] and [0169.0.0.0] above.

The invention further relates to nucleic acid molecules that differ from one of the nucleotide sequences shown in table I, application no. 20, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 20, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 20, columns 5 and 7 or the functional homologues. In a still further embodiment, the nucleic acid molecule of the invention encodes a full length protein which is substantially homologous to an amino acid sequence shown in table II, application no. 20, columns 5 and 7 or the functional homologues. However, in a preferred embodiment, the nucleic acid molecule of the present invention does not consist of the sequence shown in table I, application no. 20, columns 5 and 7, preferably as indicated in table IA, application no. 20, columns 5 and 7. Preferably the nucleic acid molecule of the invention is a functional homologue or identical to a nucleic acid molecule indicated in table IB, application no. 20, columns 5 and 7.

for the disclosure of the paragraphs [0171.0.0.19] to [0173.0.0.19] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 20, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 20, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 20, columns 5 and 7.

for the disclosure of the paragraphs [0179.0.0.19] and [0180.0.0.19] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 20, columns 5 and 7, preferably shown in table IIA, application no. 20, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 20, columns 5 and 7, preferably shown in table IIA, application no. 20, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 20, columns 5 and 7, preferably shown in table IIA, application no. 20, columns 5 and 7, more preferably at least about 70% identical to one of the sequences shown in table II, application no. 20, columns 5 and 7, preferably shown in table IIA, application no. 20, columns 5 and 7, even more preferably at least about 80%, 90%, 95% homologous to the sequence shown in table II, application no. 20, columns 5 and 7, preferably shown in table IIA, application no. 20, columns 5 and 7, and most preferably at least about 96%, 97%, 98%, or 99% identical to the sequence shown in table II, application no. 20, columns 5 and 7, preferably shown in table IIA, application no. 20, columns 5 and 7.

for the disclosure of the paragraphs [0182.0.0.19] to [0188.0.0.19] see paragraphs [0182.0.0.0] to [0188.0.0.0] above.

Functional equivalents derived from one of the polypeptides as shown in table II, application no. 20, columns 5 and 7, preferably shown in table IIB, application no. 20, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 20, columns 5 and 7, preferably shown in table IIB, application no. 20, columns 5 and 7 resp., according to the invention and are distinguished by essentially the same properties as the polypeptide as shown in table II, application no. 20, columns 5 and 7, preferably shown in table IIB, application no. 20, columns 5 and 7.

Functional equivalents derived from the nucleic acid sequence as shown in table I, application no. 20, columns 5 and 7, preferably shown in table IB, application no. 20, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 20, columns 5 and 7, preferably shown in table IIB, application no. 20, columns 5 and 7 resp., according to the invention and encode polypeptides having essentially the same properties as the polypeptide as shown in table II, application no. 20, columns 5 and 7, preferably shown in table IIB, application no. 20, columns 5 and 7.

for the disclosure of this paragraph see paragraph [0191.0.0.0] above.

A nucleic acid molecule encoding an homologous to a protein sequence of table II, application no. 20, columns 5 and 7, preferably shown in table IIB, application no. 20, columns 5 and 7 resp., can be created by introducing one or more nucleotide substitutions, additions or deletions into a nucleotide sequence of the nucleic acid molecule of the present invention, in particular of table I, application no. 20, columns 5 and 7, preferably shown in table IB, application no. 20, columns 5 and 7 resp., such that one or more amino acid substitutions, additions or deletions are introduced into the encoded protein. Mutations can be introduced into the encoding sequences of table I, application no. 20, columns 5 and 7, preferably shown in table IB, application no. 20, columns 5 and 7 resp., by standard techniques, such as site-directed mutagenesis and PCR-mediated mutagenesis.

for the disclosure of the paragraphs [0193.0.0.19] to [0196.0.0.19] see paragraphs [0193.0.0.0] to [0196.0.0.0] above.

Homologues of the nucleic acid sequences used, with the sequence shown in table I, application no. 20, columns 5 and 7, preferably shown in table IB, application no. 20, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 20, columns 5 and 7, preferably shown in table IB. application no. 20, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 20, columns 5 and 7, preferably shown in table IB, application no. 20, columns 5 and 7. It is preferred that the nucleic acid molecule comprises as little as possible other nucleotides not shown in any one of table I, application no. 20, columns 5 and 7, preferably shown in table IB, application no. 20, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 20, columns 5 and 7, preferably shown in table IB, application no. 20, columns 5 and 7.

Also preferred is that the nucleic acid molecule used in the process of the invention encodes a polypeptide comprising the sequence shown in table II, application no. 20, columns 5 and 7, preferably shown in table IIB, application no. 20, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 20, columns 5 and 7, preferably shown in table IIB, application no. 20, columns 5 and 7.

In one embodiment, the nucleic acid molecule of the invention or used in the process encodes a polypeptide comprising the sequence shown in table II, application no. 20, columns 5 and 7, preferably shown in table IIB, application no. 20, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 20, columns 5 and 7, preferably shown in table IB, application no. 20, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 20, columns 5 and 7 expressed under identical conditions.

Homologues of table I, application no. 20, columns 5 and 7 or of the derived sequences of table II, application no. 20, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.19] to [0215.0.0.19] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 20, columns 5 and 7, preferably in table IIB, application no. 20, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 20, columns 5 and 7, preferably in table IB, application no. 20, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 20, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 20, column 7 and conferring an increase in the amount of the fine chemical in an organism or a part thereof;

k) nucleic acid molecule encoding the amino acid sequence of a polypeptide encoding a domaine of the polypeptide shown in table II, application no. 20, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 20, columns 5 and 7 or a nucleic acid molecule encoding, preferably at least the mature form of, the polypeptide shown in table II, application no. 20, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 20, columns 5 and 7 by one or more nucleotides. In one embodiment, the nucleic acid molecule of the invention does not consist of the sequence shown in table IA and/or IB, application no. 20, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 20, columns 5 and 7. In a further embodiment the nucleic acid molecule does not encode the polypeptide sequence shown in table IIA and/or IIB, application no. 20, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 20, columns 5 and 7 does not encode a protein of the sequence shown in table IIA and/or IIB, application no. 20, columns 5 and 7. Accordingly, in one embodiment, the protein encoded by a sequence of a nucleic acid according to (a) to (l) does not consist of the sequence shown in table IA and/or IB, application no. 20, columns 5 and 7. In a further embodiment, the protein of the present invention is at least 30% identical to protein sequence depicted in table IIA and/or IIB, application no. 20, columns 5 and 7 and less than 100%, preferably less than 99.999%, 99.99% or 99.9%, more preferably less than 99%, 985, 97%, 96% or 95% identical to the sequence shown in table IIA and/or IIB, application no. 20, columns 5 and 7.

for the disclosure of the paragraphs [0217.0.0.19] to [0226.0.0.19] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446451. The vectors are preferably modified in such a manner, that they already contain the nucleic acid coding for the transitpeptide and that the nuleic acids of the invention, preferentially the nucleic acid sequences encoding the polypeptides shown in table II, application no. 20, columns 5 and 7 can be cloned 3' prime to the transitpeptide encoding sequence, leading to a functional pre-protein, which is directed to the plastids and which means that the mature protein fulfills its biological activity.

for the disclosure of the paragraphs [0228.0.0.19] to [0239.0.0.19] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 20, columns 5 and 7 or its derivatives, it is advantageous additionally to express and/or mutate further genes in the organisms. Especially advantageously, additionally at least one further gene of the starch and/cellulose, glucose, UDP-glucose, fructose, myo-inositol, sucrose and/or raffinose biosynthetic pathway is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 20, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the carbohydrate metabolism, in particular in synthesis of starch and/cellulose, glucose, UDP-glucose, fructose, myo-inositol, sucrose and/or raffinose. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the abovementioned biosynthesis genes are the sequences encoding further genes of the carbohydrate metabolism such as genes for glucose phosphate isomerase, triose phosphate isomerase, phosphoglycerate mutase, pyruvate kinase, fructokinase etc. It is also possible that the regulation of the natural genes has been modified advantageously so that the gene and/or its gene product is no longer subject to the regulatory mechanisms which exist in the organisms. This leads to an increased synthesis of the carbohydrates, preferably starch and/cellulose, glucose, UDP-glucose, fructose, myo-inositol, sucrose and/or raffinose, as desired since, for example, feedback regulations no longer exist to the same extent or not at all.

In a further advantageous embodiment of the process of the invention, the organisms used in the process are those in which advantageously simultaneously a starch and/cellulose, glucose, UDP-glucose, fructose, myo-inositol, sucrose and/or raffinose degrading protein is attenuated, in particular by reducing the rate of expression of the corresponding gene, or by inactivating the gene for example the mutagenesis and/or selection. In another advantageous embodiment the synthesis of competitive pathways which rely on the same precoursers are down regulated or interrupted.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemical and other carbohydrates produced by this process can be obtained by harvesting the organisms, either from the crop in which they grow, or from the field. This can be done via for example pressing or extraction of the plant parts.

Preferably, the compound is a composition comprising the essentially pure starch and/cellulose, glucose, UDP-glucose, fructose, myo-inositol, sucrose and/or raffinose or a recovered or isolated starch and/cellulose, glucose, UDP-glucose, fructose, myo-inositol, sucrose and/or raffinose.

for the disclosure of the paragraphs [0243.0.0.19] to [0264.0.0.19] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastidtransit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 20, columns 5 and 7 and described herein to achieve an expression in one of said compartments or extracellular.

for the disclosure of the paragraphs [0266.0.0.19] to [0287.0.0.19] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 20, columns 5 and 7 or their homologs is functionally linked to a plastidial targeting sequence. A further preferred embodiment of the invention relates to a vector in which a nucleic acid sequence encoding one of the polypeptides shown in table II, application no. 20, columns 5 and 7 or their homologs is functionally linked to a regulatory sequences which permit the expression in plastids.

for the disclosure of the paragraphs [0289.0.0.19] to [0296.0.0.19] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0146, anti-b0342, anti-b0523, anti-b0598, anti-b0644, anti-b0760, anti-b1046, anti-b1095, anti-b1136, anti-b1399, anti-b1410, anti-b1556, anti-b1704, anti-b1980, anti-b2223, anti-b2240, anti-b2284, anti-b2965, anti-b3156, anti-b3708, anti-YCR012W, anti-YDR035W, anti-YDR497C, anti-YER063W, anti-YGL065C, anti-YGR255C, anti-YGR262C, anti-YHR204W, anti-YIR020W-A, anti-YJL139C, antiYKR043C, anti-YLL033W, anti-YLR153C, anti-YLR174W, anti-YNL022C, anti-YNL241C, anti-YNR012W, anti-YOR353C, anti-YPL138C and/or anti-YPR035W protein antibody or an antibody against polypeptides as shown in table II, application no. 20, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 20, columns 5 and 7 or as coded by the nucleic acid molecule shown in table I, application no. 20, columns 5 and 7 or functional homologues thereof.

In one advantageous embodiment, in the method of the present invention the activity of a polypeptide is increased comprising or consisting of the consensus sequence shown in table IV, application no. 20, columns 7 and in one another embodiment, the present invention relates to a polypeptide comprising or consisting of the consensus sequence shown in table IV, application no. 20, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.19] to [0304.0.0.19] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 20, columns 5 and 7 by one or more amino acids. In one embodiment, polypeptide distinguishes form the sequence shown in table IIA and/or IIB, application no. 20, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 20, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 20, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 20, columns 5 and 7 by one or more amino acids. In another embodiment, said polypeptide of the invention does not consist of the sequence shown in table IIA and/or IIB, application no. 20, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 20, columns 5 and 7.

In one embodiment, the present invention relates to a polypeptide having the activity of the protein as shown in table IIA and/or IIB, application no. 20, column 3, which distinguishes over the sequence depicted in table IIA and/or IIB, application no. 20, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.19] to [0311.0.0.19] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 20, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 20, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 20, columns 5 and 7 or which is homologous thereto, as defined above.

Accordingly the polypeptide of the present invention can vary from the sequences shown in table IIA and/or IIB, application no. 20, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 20, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present. invention, e.g., the amino acid sequence shown in table II, application no. 20, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 20, column 3. Differences shall mean at least one amino acid different from the sequences as shown in table II, application no. 20, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 20, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 20, column 3. The nucleic acid molecules and polypeptide molecules of the invention are expressed such that the yield, production, and/or efficiency of production of a desired compound is improved.

for the disclosure of the paragraphs [0320.0.0.19] to [0322.0.0.19] see paragraphs [0320.0.0.0] to [0322.0.0.0] above.

In one embodiment, a protein (=polypeptide) as shown in table II, application no. 20, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 20, column 3, e.g., a protein which does not confer the activity described herein and which is derived from the same or a different organism.

for the disclosure of the paragraphs [0324.0.0.19] to [0329.0.0.19] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 20, columns 5 and 7.

for the disclosure of the paragraphs [0331.0.0.19] to [0346.0.0.19] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 20, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 20, column 3 or a protein as shown in table II, application no. 20, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 20, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.19] to [0358.0.0.19] see paragraphs [0350.0.0.0] to [0358.0.0.0] above.

Transgenic plants comprising starch and/cellulose, glucose, UDP-glucose, fructose, myo-inositol, sucrose and/or raffinose or mixtures thereof synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The starch and/cellulose, glucose, UDP-glucose, fructose, myo-inositol, sucrose and/ or raffinose produced in the process according to the invention may, however, also be isolated from the plant in the form of their free starch and/cellulose, glucose, UDP-glucose, fructose, myo-inositol, sucrose and/or raffinose produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, cosmetics, pharmaceuticals or fine chemicals.

for the disclosure of the paragraphs [0360.0.0.19] to [0362.0.0.19] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the starch and/cellulose, glucose, UDP-glucose, fructose, myo-inositol, sucrose and/or raffinose produced in the process can be isolated. The resulting fine chemical can, if appropriate, subsequently be further purified, if desired mixed with other active ingredients such as other xanthophylls, fatty acids, vitamins, amino acids, carbohydrates, antibiotics and the like, and, if appropriate, formulated.

In one embodiment, starch and/cellulose, glucose, UDP-glucose, fructose, myo-inositol, sucrose and/or raffinose is the fine chemical.

The starch and/cellulose, glucose, UDP-glucose, fructose, myoinositol, sucrose and/or raffinose, in particular the respective fine chemicals obtained in the process are suitable as starting material for the synthesis of further products of value. For example, they can be used in combination with each other or alone for the production of pharmaceuticals, health products, foodstuffs, animal feeds, nutrients or cosmetics. Accordingly, the present invention relates a method for the production of pharmaceuticals, health products, food stuff, animal feeds, nutrients or cosmetics comprising the steps of the process according to the invention, including the isolation of the starch and/cellulose, glucose, UDP-glucose, fructose, myo-inositol, sucrose and/or raffinose containing, in particular starch and/cellulose, glucose, UDP-glucose, fructose, myo-inositol, sucrose and/or raffinose containing composition produced or the respective fine chemical produced if desired and formulating the product with a pharmaceutical acceptable carrier or formulating the product in a form acceptable for an application in agriculture. A further embodiment according to the invention is the use of the starch and/cellulose, glucose, UDP-glucose, fructose, myo-inositol, sucrose and/or raffinose produced in the process or of the transgenic organisms in animal feeds, foodstuffs, medicines, food supplements, cosmetics or pharmaceuticals.

for the disclosure of the paragraphs [0366.0.0.19] to [0369.0.0.19] see paragraphs [0366.0.0.0] to [0369.0.0.0] above.

The fermentation broths obtained in this way, containing in particular starch and/cellulose, glucose, UDP-glucose, fructose, myo-inositol, sucrose and/or raffinose in mixtures with other organic acids, amino acids, polypeptides or polysaccarides, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the starch and/cellulose, glucose, UDP-glucose, fructose, myo-inositol, sucrose and/or raffinose, in particular the starch and/cellulose, glucose, UDP-glucose, fructose, myo-inositol, sucrose and/or raffinose produced according to the invention further. For this purpose, the product-containing composition, e.g. a total or partial extraction fraction using organic solvents, is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.19] to [0376.0.0.19], [0376.1.0.19] and [0377.0.0.19] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting-; e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 20, columns 5 and 7, preferably in table IB, application no. 20, columns 5 and 7, and, optionally, isolating the full length cDNA clone or complete genomic clone;

(c) introducing the candidate nucleic acid molecules in host cells, preferably in a plant cell or a microorganism, appropriate for producing the fine chemical;

(d) expressing the identified nucleic acid molecules in the host cells;

(e) assaying the fine chemical level in the host cells; and (f) identifying the nucleic acid molecule and its gene product which expression confers an increase in the fine chemical level in the host cell after expression compared to the wild type.

for the disclosure of the paragraphs [0379.0.0.19] to [0383.0.0.19] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 20, column 3, e.g. comparing near identical organisms with low and high activity of the proteins as shown in table II, application no. 20, column 3.

for the disclosure of the paragraphs [0385.0.0.19] to [0404.0.0.19] see paragraphs [0385.0.0.0] to [0404.0.0.0] above.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other carbohydrates, in particular carbohydrates such as cellobiose, mannose, trehalose, etc.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorgansms, the plant, plant tissue, plant cell, or the part thereof of the invention, the vector of the invention, the agonist identified with the method of the invention, the antibody of the present invention, can be used for the reduction of the fine chemical in an organism or part thereof, e.g. in a cell.

for the disclosure of the paragraphs [0406.0.0.19] to [0435.0.0.19] see paragraphs [0406.0.0.0] to [0435.0.0.0] above.

Production of Starch and/Cellulose, Glucose, UDP-glucose, Fructose, Myo-inositol, Sucrose and/or Raffinose in *Chlamydomonas reinhardtii*

The starch and/cellulose, glucose, UDP-glucose, fructose, myo-inositol, sucrose and/or raffinose production can be analysed as mentioned herein.

The proteins and nucleic acids can be analysed as mentioned below.

In addition a production in other organisms such as plants or microorganisms such as yeast, *Mortierella alpina, Corynebacterium glutamicum* or *Escherichia coli* is possible.

for the disclosure of the paragraphs [0437.0.0.19] and [0438.0.0.19] see paragraphs [0437.0.0.0] and [0438.0.0.0] above.

Example 9

Analysis of the Effect of the Nucleic Acid Molecule on the Production of Starch and/Cellulose, Glucose, UDP-Glucose, Fructose, Myo-Inositol, Sucrose and/or Raffinose The effect of the genetic modification of plants or algae on the production of a desired compound (such as starch and/cellulose, glucose, UDP-glucose, fructose, myo-inositol, sucrose and/or raffinose) can be determined by growing the modified plant under suitable conditions (such as those described above) and analyzing the medium and/or the cellular components for the elevated production of desired product (i.e. of starch and/cellulose, glucose, UDP-glucose, fructose, myo-inositol, sucrose and/or raffinose). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter II, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of and Determination of the Starch and/Cellulose, Glucose, UDP-glucose, Fructose, Myo-inositol, Sucrose and/or Raffinose Content:

Abbreviations: GC-MS, gas liquid chromatography/mass spectrometry; TLC, thin-layer chromatography.

The unambiguous detection for the presence of carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose, glucose derivatives such as UDP-glucose or anhydroglucose can be obtained by analyzing recombinant organisms using analytical standard methods: GC, GC-MS, LC, LC-MSMS or TLC, as described in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). The total carbohydrate produced in the organism for example in yeasts used in the inventive process can be analysed for example according to the following procedure:

The material such as yeasts, *E. coli* or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of an extraction using solvents such as acetone or alcohols as ethanol, methanol, or ethers, preferably ethanol, and chromatography. E.g.:

For the identification of carbohydrates the extracts should be further cleaned up by sequentially filtering through for example a Sep-Pak Plus C18 cartridge (Waters, Milford, Mass.) and a 0.22 μm membrane filter. The eluent can is injected onto an HPLC. For the detection of carbohydrates an aminopropyl-bonded phase column with a mobile phase consisting of an isocratic acetonitrile and water solution (75:25) is useful. It is advantageously to dissolve dried sugar standards in 60% ethanol and to spike said standard solutions into the samples for the analysis to monitor recovery. The carbohydrate concentrations can be calculated based on peak area measurements. For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. Injections were 20 μl.

% for the disclosure of the paragraphs [0446.0.0.19] to [0496.0.0.19] see paragraphs [0446.0.0.0] to [0496.0.0.0] above.

As an alternative, the carbohydrates, preferably polysaccharides, more preferably starch and/or cellulose and/or monosaccharides, more preferably fructose, glucose and/or myo-inositol and/or trisaccharides, more preferably raffinose and/or disaccharides, more preferably sucrose can be detected advantageously as for example described by Sonnebald et al., (Nat Biotechnol. 1997 August; 15(8):794-7), or Panikulangara et al., Plant Physiol. 2004 October; 136(2): 3148-58.

The results of the different plant analyses can be seen from the table,

TABLE VI

| ORF | Metabolite | Analyte | Method | Min | Max |
|---|---|---|---|---|---|
| b0146 | Starch/cellulose | Anhydroglucose | GC | 1.39 | 1.73 |
| b0342 | Starch/cellulose | Anhydroglucose | GC | 1.34 | 1.69 |
| b0523 | Starch/cellulose | Anhydroglucose | GC | 1.49 | 1.78 |
| b0598 | Glucose | Glucose | GC | 1.58 | 2.04 |
| b0644 | Starch/cellulose | Anhydroglucose | GC | 1.37 | 1.66 |
| b0760 | Glucose | Glucose | GC | 1.97 | 4.52 |
| b1046 | Starch/cellulose | Anhydroglucose | GC | 1.31 | 1.82 |
| b1095 | Fructose | Fructose | GC | 2.13 | 5.78 |
| b1095 | myo-Inositol | myo-Inositol | GC | 1.92 | 3.19 |
| b1095 | Glucose | Glucose | GC | 1.72 | 4.58 |
| b1136 | Starch/cellulose | Anhydroglucose | GC | 1.31 | 1.72 |
| b1399 | myo-Inositol | myo-Inositol | GC | 1.27 | 2.08 |
| b1410 | Glucose | Glucose | GC | 1.57 | 4.77 |
| b1410 | myo-Inositol | myo-Inositol | GC | 1.34 | 1.49 |
| b1410 | Fructose | Fructose | GC | 1.87 | 5.27 |
| b1556 | Sucrose | Sucrose | GC | 1.31 | 1.37 |
| b1556 | myo-Inositol | myo-Inositol | GC | 1.25 | 3.07 |
| b1556 | Raffinose | Raffinose | GC | 1.85 | 4.09 |
| b1704 | Starch/cellulose | Anhydroglucose | GC | 1.24 | 2.01 |
| b1980 | Raffinose | Raffinose | LC | 1.67 | 2.01 |
| b2223 | myo-Inositol | myo-Inositol | GC | 1.26 | 4.32 |
| b2223 | Raffinose | Raffinose | LC | 1.72 | 6.17 |
| b2223 | Glucose | Glucose | GC | 1.60 | 6.20 |
| b2284 | Starch/cellulose | Anhydroglucose | GC | 1.66 | 1.68 |
| b2240 | Starch/cellulose | Anhydroglucose | GC | 1.31 | 1.90 |
| b2965 | Sucrose | Sucrose | GC | 1.30 | 4.29 |
| b3156 | Fructose | Fructose | GC | 2.14 | 2.97 |
| b3708 | Raffinose | Raffinose | LC | 1.61 | 3.49 |
| YCR012W | Raffinose | Raffinose | LC | 1.57 | 3.81 |
| YDR035W | Raffinose | Raffinose | LC | 1.71 | 5.40 |
| YDR497C | Fructose | Fructose | GC | 2.06 | 6.27 |
| YDR497C | myo-Inositol | myo-Inositol | GC | 1.26 | 1.29 |
| YER063W | Fructose | Fructose | GC | 1.68 | 1.80 |
| YGL065C | myo-Inositol | myo-Inositol | GC | 1.12 | 1.23 |
| YGL065C | Starch/cellulose | Anhydroglucose | GC | 1.40 | 1.47 |
| YGR255C | Glucose | Glucose | GC | 1.82 | 4.94 |
| YGR255C | Raffinose | Raffinose | LC | 1.72 | 2.51 |
| YGR262C | Fructose | Frucfose | GC | 1.58 | 2.06 |
| YGR262C | Glucose | Glucose | GC | 1.65 | 1.77 |
| YHR204W | myo-Inositol | myo-Inositol | GC | 1.30 | 1.52 |
| YIR020W-A | Fructose | Fructose | GC | 1.84 | 2.07 |
| YIR020W-A | Glucose | Glucose | GC | 1.46 | 1.87 |
| YJL139C | myo-Inositol | myo-Inositol | GC | 1.27 | 2.35 |
| YJL139C | Glucose | Glucose | GC | 1.64 | 2.57 |
| YKR043C | UDPGlucose | UDPGlucose | LC | 1.66 | 1.72 |
| YLL033W | Raffinose | Raffinose | LC | 1.81 | 1.82 |
| YLR153C | Glucose | Glucose | GC | 1.64 | 4.06 |
| YLR174W | Raffinose | Raffinose | LC | 1.61 | 1.86 |
| YLR174W | myo-Inositol | myo-Inositol | GC | 1.25 | 1.32 |
| YNL022C | Raffinose | Raffinose | LC | 1.59 | 1.62 |
| YNL241C | Glucose | Glucose | GC | 2.99 | 5.30 |
| YNL241C | Fructose | Fructose | GC | 1.86 | 4.64 |
| YNR012W | myo-Inositol | myo-Inositol | GC | 1.31 | 1.64 |
| YOR353C | Fructose | Fructose | GC | 1.78 | 3.87 |
| YOR353C | Glucose | Glucose | GC | 1.66 | 2.41 |
| YPL138C | Starch/cellulose | Anhydroglucose | GC | 1.31 | 2.14 |
| YPR035W | myo-Inositol | myo-Inositol | GC | 1.27 | 4.65 |
| YPR035W | Raffinose | Raffinose | LC | 2.02 | 2.25 | for the disclosure of the paragraphs [0499.0.0.19] and [0500.0.0.19] see paragraphs [0499.0.0.0] and [0500.0.0.0] above.

Example 15a

Engineering Ryegrass Plants by Over-Expressing b0146 from *Escherichia coli* or Homologs of b0146 from Other Organisms for the disclosure of the paragraphs [0502.0.0.19] to [0508.0.0.19] see paragraphs [0502.0.0.0] to [0508.0.0.0] above.

Example 15b

Engineering Soybean Plants by Over-Expressing b0146 from *Escherichia coli* or Homologs of b0146 from Other Organisms for the disclosure of the paragraphs [0510.0.0.19] to [0513.0.0.19] see paragraphs [0510.0.0.0] to [0513.0.0.0] above.

Example 15c

Engineering Corn Plants by Over-Expressing b0146 from *Escherichia coli* or Homologs of b0146 from Other Organisms for the disclosure of the paragraphs [0515.0.0.19] to [0540.0.0.19] see paragraphs [0515.0.0.0] to [0540.0.0.0] above.

Example 15d

Engineering Wheat Plants by Over-Expressing b0146 from *Escherichia coli* or Homologs of b0146 from Other Organisms for the disclosure of the paragraphs [0542.0.0.19] to [0544.0.0.19] see paragraphs [0542.0.0.0] to [0544.0.0.0] above.

Example 15e

Engineering Rapeseed/Canola Plants by Over-Expressing b0146 from *Escherichia coli* or Homologs of b0146 from Other Organisms for the disclosure of the paragraphs [0546.0.0.19] to [0549.0.0.19] see paragraphs [0544.0.0.0] to [0549.0.0.0] above.

Example 15f

Engineering Alfalfa Plants by Over-Expressing b0146 from *Escherichia coli* or Homologs of b0146 from Other Organisms for the disclosure of the paragraphs [0551.0.0.19] to [0554.0.0.19] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII

TABLE VII

| ORF_NAME | Metabolite | MIN | MAX |
|---|---|---|---|
| YGR255C | Raffinose | 2.32 | 3.59 |
| YGR255C | Glucose | 1.86 | 5.59 |
| YKR043C | UDP-Glucose | 2.01 | 3.59 |
| YNL241C | Glucose | 1.66 | 2.27 |
| YNR012W | myo-Inositol | 1.76 | 6.87 |

Table VII shows the increase in raffinose, glucose, UDP-glucose and myo-inositol in genetically modified corn plants expressing the *Saccharomyces cerevisiae* nucleic acid sequences YGR255C, YKR043C, YNL241C and YNR012W.

In one embodiment, in case the activity of the *Saccharomyces cerevisiae* protein YGR255C or its homologs, e.g. a "Putative flavin-dependent monooxygenase, involved in ubiquinone (Coenzyme Q) biosynthesis", is increased in corn plants, preferably, an increase of the fine chemical raffinose between 132% and 259% is conferred.

In one embodiment, in case the activity of the *Saccharomyces cerevisiae* protein YGR255C or its homologs, e.g. a "Putative flavin-dependent monooxygenase, involved in ubiquinone (Coenzyme Q) biosynthesis", is increased in corn plants, preferably, an increase of the fine chemical glucose between 86% and 459% is conferred.

In one embodiment, in case the activity of the *Saccharomyces cerevisiae* protein YGR255C or its homologs, e.g. a "Putative flavin-dependent monooxygenase, involved in ubiquinone (Coenzyme Q) biosynthesis", is increased in corn plants, preferably, an increase of the fine chemicals raffinose between 132% and 259% or more and of glucose between 86% and 459% or more is conferred.

In one embodiment, in case the activity of the *Saccharomyces cerevisiae* protein YKR043C or its homologs, e.g. a "phosphoglycerate mutase like protein", is increased in corn plants, preferably, an increase of the fine chemical UDP-glucose between 101% and 259% is conferred.

In one embodiment, in case the activity of the *Saccharomyces cerevisiae* protein YNL241C or its homologs, e.g. a "glucose-6-phosphate dehydrogenase", is increased in corn plants, preferably, an increase of the fine chemical glucose between 66% and 127% is conferred.

In one embodiment, in case the activity of the *Saccharomyces cerevisiae* protein YNR012W or its homologs, e.g. a "uridine kinase", is increased in corn plants, preferably, an increase of the fine chemical myo-inositol between 76% and 587% is conferred.

for the disclosure of this paragraph see [0554.2.0.0] above.
for the disclosure of this paragraph see [0555.0.0.0] above.
for the disclosure of this paragraph see [0001.0.0.0].

Plants produce very long chain fatty acids such as behenic acid (C22:0), lignoceric acid (C24:0), cerotic acid (C26:0) and/or melissic acid (C30:0).

Very long-chain fatty acids (VLCFAs) are synthesized by a membrane-bound fatty acid elongation complex (elongase, FAE) using acyl-CoA substrates. The first reaction of elongation involves condensation of malonyl-CoA with a long chain substrate producing a β-ketoacyl-CoA. Subsequent reactions are reduction of β-hydroxyacyl-CoA, dehydration to an enoyl-CoA, followed by a second reduction to form the elongated acyl-CoA. The β-ketoacyl-CoA synthase (KCS) catalyzing the condensation reaction plays a key role in determining the chain length of fatty acid products found in seed oils and is the rate-limiting enzyme for seed VLCFA production (Lassner et al., Plant Cell, 8(1996), 281-292).

The elongation process can be repeated to yield members that are 20, 22, and 24 carbons long. Although such very long chain fatty acids are minor components of the lipid membranes of the body, they undoubtedly perform valuable functions, apparently helping to stabilize membranes, especially those in peripheral nerve cells.

Behenic acid (22:0) (docosanoic acid) is a component of rapeseed oil (up to 2%) and peanut oil (1-5%).

Behenic acid is used to give hair conditioners and moisturizers their smoothing properties.

Lignoceric acid (24:0) (tetracosanoic acid) is a component of rapeseed oil (up to 1%) and peanut oil (1-3%).

Cerotic acid (26:0) (hexacosanoic acid) is a component of beeswax.

*Echinacea angustifolia* extracts are sold as natural health products comprising the very long chain fatty acid cerotic acid.

Cerotic acid is used in cosmetics as a constituent in hair-styling products.

Melissic acid (C30:0) (triacontanoic acid) is a component of beeswax.

Beeswax (cera alba) is obtained from the product excreted by certain glands of the honeybee from which the honeycomb is made. It is freed of solid impurities by melting and centrifugation (cera flava). Finally, it is bleached completely white (cera alba).

Beeswax consists of 10-15 percent paraffin carbohydrates, 35-37 percent esters of C16 to C36 fatty acids and about 15 percent cerotic acid, melissic acid and their homologues. Beeswax is used as a thickener and a humectant in the manufacture of ointments, creams, lipsticks and other cosmetics and skincare products as an emulsifier, emollient, moisturizer and film former.

Beeswax is also used for the production of candles.

Wax is a general term used to refer to the mixture of long-chain apolar lipids forming a protective coating (cutin in the cuticle) on plant leaves and fruits but also in animals (wax of honeybee, cuticular lipids of insects, spermaceti of the sperm whale, skin lipids, uropygial glands of birds, depot fat of planktonic crustacea), algae, fungi and bacteria.

Many of the waxes found in nature have commercial uses in the lubricant, food and cosmetic industry. Jojoba oil has long been suggested as a putative resource of wax, since this desert shrub is unusual in its capacity to produce waxes rather than triacylglycerols (TAG) as seed storage lipids. These waxes are esters of very-long-chain-fatty acids and fatty alcohols (Miwa, 1971, J Am Oil Chem Soc 48, 259-264). As the production cost for jojoba wax, which is primarily used for cosmetic applications, is high, there is a need to engineer crop plants to produce high level of wax esters in its seed oil.

Plant aerial surfaces are covered by epicuticular waxes, complex mixtures of very long ($C_{20}$-$C_{34}$) fatty acids, alkanes, aldehydes, ketones and esters. In addition to repelling atmospheric water they prevent dessication and are therefore an important determinant of drought resistance (Riederer and Schreiber, 2001, J. Exp. Bot 52, 2023-2032). Beside abiotic stress resistance the wax layer is part of the plant defense against biotic stressor, especially insects as for example described by Marcell and Beattie, 2002, Mol Plant Microbe Interact. 15(12), 1236-44. Furthermore they provide stability to pollen grains, thus influencing fertility and productivity.

Very-long-chain fatty acids (VLCFAs), consisting of more than 18 carbon atoms like behenic acid, lignoceric acid, cerotic acid and melissic acid, are essential components for the vitality of higher plants. The key enzyme of VLCFA biosynthesis, the extraplastidary fatty acid elongase, is shown for to be the primary target site of chloroacetamide herbicides. With an analysis of the fatty acid composition and the metabolism of 14C-labelled precursors (sterate, malonate, acetate), the reduction of VLCFAs was determined in vivo. The inhibition of the recombinant protein substantiates the first and rate-limiting step of VLCFA biosynthesis, the condensation of acyl-CoA with malonyl-CoA to β-ketoacyl-CoA, to be the primary target site of chloroacetamides (150=10–100 nM). The concentration of VLCFAs within the untreated cell is low, the very-long-chain compounds are found mainly in plasma membrane lipids and epicuticular waxes. A shift of fatty acids towards shorter chain length or even the complete depletion of very-long-chain components is the consequence of the inhibition of VLCFA biosynthesis. Especially the loss of plasma membrane VLCFAs is involved in phytotoxic effects of chloroacetamides such as the inhibition of membrane biogenesis and mitosis (Matthes, B., http://www.ub.unikonstanz.de/kops/volltexte/2001/661/).

Increased wax production in transgenic plants has for example been reported by Broun et al., 2004, Proc Natl. Acad. Sci, 101, 47064711. The authors overexpressed the transcriptional activator WIN1 in *Arabidopsis*, leading to increased wax load on arial organs. As this resulted in a complex change in the wax profile and the transgenic overexpressors had characteristic alterations in growth and development (Broun et al., 2004, Proc Natl. Acad. Sci, 101, 4706-4711) there is still a need for a more controlled increased production of defined VLCFAs.

Very long chain fatty alcohols obtained from plant waxes and beeswax have also been reported to lower plasma cholesterol in humans and existing data support the hypothesis that VLCFA exert regulatory roles in cholesterol metabolism in the peroxisome and also alter LDL uptake and metabolism (discussed in Hargrove et al., 2004, Exp Biol Med (Maywood), 229(3): 215-26).

Due to these interesting physiological roles and the nutritional, cosmetic and agrobiotechnological potential of behenic acid (C22:0), lignoceric acid (C24:0), cerotic acid (C26:0) and melissic acid (C30:0) there is a need to identify the genes of enzymes and other proteins involved in behenic acid, lignoceric acid, cerotic acid or melissic acid metabolism, and to generate mutants or transgenic plant lines with which to modify the behenic acid, lignoceric acid, cerotic acid or melissic acid content in plants.

One way to increase the productive capacity of biosynthesis is to apply recombinant DNA technology. Thus, it would be desirable to produce behenic acid, lignoceric acid, cerotic acid or melissic acid in plants. That type of production permits control over quality, quantity and selection of the most suitable and efficient producer organisms. The latter is especially important for commercial production economics and therefore availability to consumers. In addition it is desirable to produce behenic acid, lignoceric acid, cerotic acid or melissic acid in plants in order to increase plant productivity and resistance against biotic and abiotic stress as discussed before.

Therefore improving the productivity of said fatty acids and improving the quality of cosmetics, pharmaceuticals, foodstuffs and animal feeds, in particular of nutrition supplements, is an important task of the different industries.

To ensure a high productivity of said fatty acids in plants or microorganism, it is necessary to manipulate the natural biosynthesis of said fatty acids in said organisms.

Thus, it would be advantageous if an algae, plant or other microorganism were available which produce large amounts behenic acid, lignoceric acid, cerotic acid or melissic acid. The invention discussed hereinafter relates in some embodiments to such transformed prokaryotic or eukaryotic microorganisms.

It would also be advantageous if plants were available whose roots, leaves, stem, fruits or flowers produced large amounts of behenic acid, lignoceric acid, cerotic acid or melissic acid. The invention discussed hereinafter relates in some embodiments to such transformed plants.

Accordingly, there is still a great demand for new and more suitable genes which encode enzymes or other regulators which participate in the biosynthesis of said fatty acids and make it possible to produce said fatty acids specifically on an industrial scale without that unwanted byproducts are formed. In the selection of genes for biosynthesis two characteristics above all are particularly important. On the one hand, there is as ever a need for improved processes for obtaining the highest possible contents of said fatty acids on the other hand as less as possible byproducts should be produced in the production process.

Therefore improving the quality of foodstuffs and animal feeds is an important task of the food-and-feed industry. This is necessary since, for example behenic acid, lignoceric acid, cerotic acid or melissic acid, as mentioned above, which occur in plants and some microorganisms are limited with regard to the supply of mammals. Especially advantageous for the quality of foodstuffs and animal feeds is as balanced as possible a specific behenic acid, lignoceric acid, cerotic acid or melissic acid profile in the diet since an excess of behenic acid, lignoceric acid, cerotic acid or melissic acid above a specific concentration in the food has a positive effect. A further increase in quality is only possible via addition of further behenic acid, lignoceric acid, cerotic acid or melissic acid, which are limiting.

To ensure a high quality of foods and animal feeds, it is therefore necessary to add behenic acid, lignoceric acid, cerotic acid or melissic acid in a balanced manner to suit the organism.

for the disclosure of this paragraph see [0013.0.0.0] above.

Accordingly, in a first embodiment, the invention relates to a process for the production of a fine chemical, whereby the fine chemical is cerotic acid, lignoceric acid and/or melissic acid in free or bound form for example bound to lipids, oils or fatty acids. Accordingly, in the present invention, the term "the fine chemical" as used herein relates to "cerotic acid, lignoceric acid and/or melissic acid in free or bound form". Further, the term "the fine chemicals" as used herein also relates to fine chemicals comprising cerotic acid, lignoceric acid and/or melissic acid in free or bound form.

In one embodiment, the term "cerotic acid, lignoceric acid and/or melissic acid in free or bound form", "the fine chemical" or "the respective fine chemical" means at least one chemical compound selected from the group consisting of cerotic acid, lignoceric acid, behenic acid or melissic acid or mixtures thereof in free or bound form. Throughout the specification the term "the fine chemical" or "the respective fine chemical" means a compound selected from the group cerotic acid lignoceric acid or melissic acid or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids.

In one embodiment, the term "the fine chemical" and the term "the respective fine chemical" mean at least one chemical compound with an activity of the abovementioned fine chemical.

In one embodiment, the term "the fine chemical" and the term "the respective fine chemical" mean at least one chemical compound with an activity of the above mentioned fine chemical Accordingly, the present invention relates to a process for the production of cerotic acid, lignoceric acid and/or melissic acid, which comprises
(a) increasing or generating the activity of a protein as shown in table II, application no. 21, column 3 encoded by the nucleic acid sequences as shown in table I, application no. 21, column 5, in an organelle of a microorganism or plant, or
(b) increasing or generating the activity of a protein as shown in table II, application no. 21, column 3 encoded by the nucleic acid sequences as shown in table I, application no. 21, column 5 in the plastid of a microorganism or plant, or in one or more parts thereof; and
(c) growing the organism under conditions which permit the production of the fine chemical, thus, cerotic acid, lignoceric acid and/or melissic acid or fine chemicals comprising cerotic acid, lignoceric acid and/or melissic acid, are produced in said organism or in the culture medium surrounding the organism.

Accordingly, the term "the fine chemical" means "cerotic acid lignoceric acid and/or melissic acid" in relation to all sequences listed in table I, application no. 21, columns 5 and 7 or homologs thereof. Accordingly, the term "the fine chemical" can mean "cerotic acid lignoceric acid and/or melissic acid", owing to circumstances and the context. Preferably the term "the fine chemical" means "cerotic acid lignoceric acid and/or melissic acid". In order to illustrate that the meaning of the term "the respective fine chemical" means "cerotic acid lignoceric acid and/or melissic acid in free or bound form" owing to the sequences listed in the context the term "the respective fine chemical" is also used.

In another embodiment the present invention is related to a process for the production of cerotic acid, lignoceric acid and/or melissic acid, which comprises
(a) increasing or generating the activity of a protein as shown in table II, application no. 21, column 3 encoded by the nucleic acid sequences as shown in table I, application no. 21, column 5, in an organelle of a non-human organism, or
(b) increasing or generating the activity of a protein as shown in table II, application no. 21, column 3 encoded by the nucleic acid sequences as shown in table I, application no. 21, column 5, which are joined to a nucleic acid sequence encoding a transit peptide in a non-human organism, or in one or more parts thereof; or
(c) increasing or generating the activity of a protein as shown in table II, application no. 21, column 3 encoded by the nucleic acid sequences as shown in table I, application no. 21, column 5, which are joined to a nucleic acid sequence encoding chloroplast localization sequence, in a non-human organism, or in one or more parts thereof, and
(d) growing the organism under conditions which permit the production of cerotic acid, lignoceric acid and/or melissic acid in said organism.

In another embodiment, the present invention relates to a process for the production of cerotic acid, lignoceric acid and/or melissic acid, which comprises
(a) increasing or generating the activity of a protein as shown in table II, application no. 21, column 3 encoded by the nucleic acid sequences as shown in table I, application no. 21, column 5, in an organelle of a microorganism or plant through the transformation of the organelle, or
(b) increasing or generating the activity of a protein as shown in table II, application no. 21, column 3 encoded by the nucleic acid sequences as shown in table I, application no. 21, column 5 in the plastid of a microorganism or plant, or in one or more parts thereof through the transformation of the plastids; and
(c) growing the organism under conditions which permit the production of the fine chemical, thus, cerotic acid, lignoceric acid and/or melissic acid or fine chemicals comprising cerotic acid, lignoceric acid and/or melissic acid in said organism or in the culture medium surrounding the organism.

Advantageously the activity of the protein as shown in table II, application no. 21, column 3 encoded by the nucleic acid sequences as shown in table I, application no. 21, column 5 is increased or generated in the abovementioned process in the plastid of a microorganism or plant.

for the disclosure of the paragraphs [0019.0.0.20] to see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 21, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 21, column 3 and its homologs as disclosed in table I, application no. 21, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 21, column 3 and its homologs as disclosed in table I, application no. 21, columns 5 and 7.

for the disclosure of the paragraphs [0027.0.0.20] to [0029.0.0.20] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 21, columns 5 and 7. The person skilled in the art is able to join said sequences in a functional manner. Advantageously the transit peptide part is cleaved off from the protein part shown in table II, application no. 21, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 21, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 21, columns 5 and 7. In case of the amino acid sequence QIA CSS the three amino acids in front of the start methionine are stemming from the LIC (=ligation independent cloning) cassette. Said short amino acid sequence is preferred in the case of the expression of E. coli genes. In case of the amino acid sequence QIA EFQLTT the six amino acids in front of the start methionine are stemming from the LIC cassette. Said short amino acid sequence is preferred in the case of the expression of S. cerevisiae genes. The skilled worker knows that other short sequences are also useful in the expression of the genes metioned in table I, application no. 21, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 21, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 21, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.20] and [0030.3.0.20] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 21, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 21, columns 5 and 7 or a sequence encoding a protein, as depicted in table II, application no. 21, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limited to ASBVd, PLMVd, CChMVd and ELVd. The viroid sequence or a functional part of it can be fused to the sequences depicted in table I, application no. 21, columns 5 and 7 or a sequence encoding a protein, as depicted in table II, application no. 21, columns 5 and 7 in such a manner that the viroid sequence transports a sequence transcribed from a sequence as depicted in table I, application no. 21, columns 5 and 7 or a sequence encoding a protein as depicted in table II, application no. 21, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 21, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 21, columns 5 and 7.

In a preferred embodiment of the invention the nucleic acid sequences as shown in table I, application no. 21, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 21, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.20] and [0032.0.0.20] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 21, column 3. Preferably the modification of the activity of a protein as shown in table II, application no. 21, column 3 or their combination can be achieved by joining the protein to a transit peptide.

Surprisingly it was found, that the transgenic expression of the *Saccaromyces cerevisiae* protein as shown in table II, application no. 21, column 3 in plastids of a plant such as *Arabidopsis thalaiana* for example through the linkage to at least one targeting sequence for example as mentioned in table V conferred an increase in the fine chemical content of the transformed plants.

for the disclosure of this paragraph see paragraph [0035.0.0.0] above.

The sequence of b1228 (Accession number A64870) from *Escherichia coli* has been published in Blattner et al., Science 277 (5331), 1453-1474 (1997), and its activity is being defined as an "unknown protein". Accordingly, in one embodiment, the process of the present invention comprises the use of an "unknown protein" or its homolog, e.g. as shown herein, for the production of the fine chemical, meaning of cerotic acid, in particular for increasing the amount of cerotic acid in free or bound form in an organism or a part thereof, as mentioned. In one embodiment, in the process of the present invention the activity of a b1228 protein is increased or generated, e.g. from *Escherichia coli* or a homolog thereof, preferably linked at least to one transit peptide as mentioned for example in table V.

In another embodiment, in the process of the present invention the activity of a b1228 protein is increased or generated in a subcellular compartment of the organism or organism cell such as in an organelle like a plastid or mitochondria.

The sequence of b2207 (Accession number E64990) from *Escherichia coli* has been published in Blattner et al., Science 277 (5331), 1453-1474 (1997), and its activity is being defined as "periplasmic nitrate reductase assembly protein". Accordingly, in one embodiment, the process of the present invention comprises the use of a "periplasmic nitrate reductase assembly protein" or its homolog, e.g. as shown herein, for the production of the fine chemical, meaning of cerotic acid, in particular for increasing the amount of cerotic acid in free or bound form in an organism or a part thereof, as mentioned. In one embodiment, in the process of the present invention the activity of a b2207 protein is increased or generated, e.g. from *Escherichia coli* or a homolog thereof, preferably linked at least to one transit peptide as mentioned for example in table V.

In another embodiment, in the process of the present invention the activity of a b2207 protein is increased or generated in a subcellular compartment of the organism or organism cell such as in an organelle like a plastid or mitochondria.

The sequence of b2965 (Accession number NP_417440) from *Escherichia coli* has been published in Blattner et al., Science 277 (5331), 1453-1474 (1997), and its activity is being defined as "ornithine decarboxylase". Accordingly, in one embodiment, the process of the present invention comprises the use of a "ornithine decarboxylase" or its homolog, e.g. as shown herein, for the production of the fine chemical, meaning of cerotic acid, in particular for increasing the amount of cerotic acid in free or bound form in an organism or a part thereof, as mentioned. In one embodiment, in the process of the present invention the activity of a b2965 protein is increased or generated, e.g. from *Escherichia coli* or a homolog thereof, preferably linked at least to one transit peptide as mentioned for example in table V.

In another embodiment, in the process of the present invention the activity of a b2965 protein is increased or generated in a subcellular compartment of the organism or organism cell such as in an organelle like a plastid or mitochondria.

The sequence of b3568 (Accession number S47789) from *Escherichia coli* has been published in Blattner et al., Science 277 (5331), 1453-1474 (1997), and its activity is being defined as "xylose transport permease protein xylH". Accordingly, in one embodiment, the process of the present invention comprises the use of a "xylose transport permease protein xylH" or its homolog, e.g. as shown herein, for the production of the fine chemical, meaning of lignoceric acid, in particular for increasing the amount of lignoceric acid in free or bound form in an organism or a part thereof, as mentioned. In one embodiment, in the process of the present invention the activity of a b3568 protein is increased or generated, e.g. from

*Escherichia coli* or a homolog thereof, preferably linked at least to one transit peptide as mentioned for example in table V.

In another embodiment, in the process of the present invention the activity of a b3568 protein is increased or generated in a subcellular compartment of the organism or organism cell such as in an organelle like a plastid or mitochondria.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase". Accordingly, in one embodiment, the process of the present invention comprises the use of a "3deoxy-D-arabino-heptulosonate-7-phosphate synthase" or its homolog, e.g. as shown herein, for the production of the fine chemical, meaning of lignoceric acid, in particular for increasing the amount of lignoceric acid in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase". Accordingly, in one embodiment, the process of the present invention comprises the use of a "3deoxy-D-arabino-heptulosonate-7-phosphate synthase" or its homolog, e.g. as shown herein, for the production of the fine chemical, meaning of melissic acid, in particular for increasing the amount of milissic acid in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase". Accordingly, in one embodiment, the process of the present invention comprises the use of a "3deoxy-D-arabino-heptulosonate-7-phosphate synthase" or its homolog, e.g. as shown herein, for the production of the fine chemical, meaning of lignoceric acid and milissic acid, in particular for increasing the amount of lignoceric acid and milissic in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of an YDR035W protein is increased or generated in a subcellular compartment of the organism or organism cell such as in an organelle like a plastid or mitochondria.

The sequence of YLR153C (Accession number NP_013254) from *Saccharomyces cerevisiae* has been published in Johnston et al., Nature 387 (6632 Suppl), 87-90 (1997) and Goffeau et al., Science 274 (5287), 546-547, 1996, and its activity is being defined as a "acetyl CoA synthetase". Accordingly, in one embodiment, the process of the present invention comprises the use of a "acetyl CoA synthetase" or its homolog, e.g. as shown herein, for the production of the fine chemical, meaning of lignoceric acid in free or bound form, in particular for increasing the amount of lignoceric acid in free or bound form in an organism or a part thereof, as mentioned. In one embodiment, in the process of the present invention the activity of a YLR153C protein is increased or generated, e.g. from *Saccharomyces cerevisiae* or a homolog thereof, preferably linked at least to one transit peptide as mentioned for example in table V.

In another embodiment, in the process of the present invention the activity of an YLR153C protein is increased or generated in a subcellular compartment of the organism or organism cell such as in an organelle like a plastid or mitochondria.

In one embodiment, the homolog of the b1228, b2207, b2965 or b3568 is a homolog having said activity and being derived from bacteria. In one embodiment, the homolog of the b1228, b2207, b2965 or b3568 is a homolog having said activity and being derived from Proteobacteria. In one embodiment, the homolog of the b1228, b2207, b2965 or b3568 is a homolog having said activity and being derived from Gammaproteobacteria. In one embodiment, the homolog of the b1228, b2207, b2965 or b3568 is a homolog having said activity and being derived from Enterobacteriales. In one embodiment, the homolog of the b1228, b2207, b2965 or b3568 is a homolog having said activity and being derived from Enterobacteriaceae. In one embodiment, the homolog of the b1228, b2207, b2965 or b3568 is a homolog having said activity and being derived from *Escherichia*, preferably from *Escherichia coli*.

In one embodiment, the homolog of the YDR035W or YLR153C is a homolog having said activity and being derived from an eukaryotic. In one embodiment, the homolog of the YDR035W or YLR153C is a homolog having said activity and being derived from Fungi. In one embodiment, the homolog of the YDR035W or YLR153C is a homolog having said activity and being derived from Ascomyceta. In one embodiment, the homolog of the YDR035W or YLR153C is a homolog having said activity and being derived from *Saccharomycotina*. In one embodiment, the homolog of the YDR035W or YLR153C is a homolog having said activity and being derived from *Saccharomycetes*. In one embodiment, the homolog of the YDR035W or YLR153C is a homolog having said activity and being derived from *Saccharomycetales*. In one embodiment, the homolog of the YDR035W or YLR153C is a homolog having said activity and being derived from Saccharomycetaceae. In one embodiment, the homolog of the YDR035W or YLR153C is a homolog having said activity and being derived from *Saccharomycetes*.

for the disclosure of this paragraph see paragraph [0038.0.0.0] above.

In accordance with the invention, a protein or polypeptide has the "activity of an protein as shown in table II, application no. 21, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 21, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 21, column 3, or which has at least 10% of the original enzymatic activity, preferably 20%, particularly preferably 30%, most particularly preferably 40% in comparison to a protein as shown in table II, application no. 21, column 3 of *Saccharomyces cerevisiae*.

for the disclosure of the paragraphs [0040.0.0.20] to [0047.0.0.20] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 21, column 3 its biochemical or genetical causes and the increased amount of the fine chemical.

for the disclosure of the paragraphs [0049.0.0.20] to [0051.0.0.20] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 21, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.20] to [0058.0.0.20] see paragraphs [0053.0.0.0] to [0058.0.0.0] above.

In case the activity of the *Escherichia coli* protein b1228 or its homologs, e.g. a "unknown protein" is increased advantageously in an organelle such as a plastid or mitochondria, preferably, in one embodiment an increase of the fine chemical, preferably of cerotic acid in free or bound form between 43% and 137% or more is conferred.

In case the activity of the *Escherichia coli* protein b2207 or its homologs, e.g. a "periplasmic nitrate reductase assembly protein" is increased advantageously in an organelle such as a plastid or mitochondria, preferably, in one embodiment an increase of the fine chemical, preferably of cerotic acid in free or bound form between 41% and 55% or more is conferred.

In case the activity of the *Escherichia coli* protein b2965 or its homologs, e.g. a "ornithine decarboxylase" is increased advantageously in an organelle such as a plastid or mitochondria, preferably, in one embodiment an increase of the fine chemical, preferably of cerotic acid in free or bound form between 55% and 191% or more is conferred. In case the activity of the *Escherichia coli* protein b3568 or its homologs, e.g. a "xylose transport permease protein xylH" is increased advantageously in an organelle such as a plastid or mitochondria, preferably, in one embodiment an increase of the fine chemical, preferably of lignoceric acid in free or bound form between 31% and 134% or more is conferred.

In case the activity of the *Saccaromyces cerevisiae* protein YDR035W or its homologs, e.g. a "3-deoxy-D-arabino-heptulosonate 7-phosphate (DAHP) synthase" is increased advantageously in an organelle such as a plastid or mitochondria, preferably, in one embodiment an increase of the fine chemical, preferably of lignoceric acid in free or bound form between 87% and 101% or more is conferred.

In case the activity of the *Saccaromyces cerevisiae* protein YDR035W or its homologs, e.g. a "3-deoxy-D-arabino-heptulosonate 7-phosphate (DAHP) synthase" is increased advantageously in an organelle such as a plastid or mitochondria, preferably, in one embodiment an increase of the fine chemical, preferably of mellissic acid in free or bound form between 30% and 75% or more is conferred.

In case the activity of the *Saccaromyces cerevisiae* protein YDR035W or its homologs, e.g. a "3-deoxy-D-arabino-heptulosonate 7-phosphate (DAHP) synthase" is increased advantageously in an organelle such as a plastid or mitochondria, preferably, in one embodiment an increase of the fine chemical, preferably of lignoceric acid in free or bound form between 53% and 126% or more is conferred.

In case the activity of the *Saccaromyces cerevisiae* protein YDR035W or its homologs, e.g. a "3-deoxy-D-arabino-heptulosonate 7-phosphate (DAHP) synthase" is increased advantageously in an organelle such as a plastid or mitochondria, preferably, in one embodiment an increase of the fine chemical, preferably of melissic acid in free or bound form between 30% and 75% or more and of lignoceric acid in free or bound form between 53% and 126% or more is conferred.

In case the activity of the *Saccaromyces cerevisiae* protein YLR153C or its homologs, e.g. a "acetyl CoA synthetase" is increased advantageously in an organelle such as a plastid or mitochondria, preferably, in one embodiment an increase of the fine chemical, preferably of lignoceric acid in free or bound form between 44% and 53% or more is conferred.

In case the activity of the *Escherichia coli* proteins b1228, b2207, b2965 b3568 or their homologs, are increased advantageously in an organelle such as a plastid or mitochondria, preferably an increase of the fine chemical such as cerotic acid, lignoceric acid or melissic acid or mixtures thereof in free or bound form is conferred.

In case the activity of the *Saccaromyces cerevisiae* protein YDR035W and/or YLR153C or their homologs, are increased advantageously in an organelle such as a plastid or mitochondria, preferably an increase of the fine chemical such as cerotic acid, lignoceric acid or melissic acid or mixtures thereof in free or bound form is conferred.

for the disclosure of the paragraphs [0061.0.0.20] and [0062.0.0.20] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 21, column 7 or of the polypeptide as shown in the amino acid sequences as disclosed in table II, application no. 21, columns 5 and 7 or the functional homologues thereof as described herein, or is encoded by the nucleic acid molecule characterized herein or the nucleic acid molecule according to the invention, for example by the nucleic acid molecule as shown in table I, application no. 21, columns 5 and 7 or its herein described functional homologues and has the herein mentioned activity.

for the disclosure of the paragraphs [0065.0.0.20] and [0066.0.0.20] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 21, columns 5 and 7 or its homologs activity having herein-mentioned cerotic acid, lignoceric acid and/or melissic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 21, columns 5 and 7, e.g. a nucleic acid sequence encoding a polypeptide having the activity of a protein as indicated in table II, application no. 21, columns 5 and 7 or its homologs activity or of a mRNA encoding the polypeptide of the present invention having herein-mentioned cerotic acid, lignoceric acid and/or melissic acid increasing activity; and/or c) increasing the specific activity of a protein conferring the increased expression of a protein encoded by the nucleic acid molecule of the invention or of the polypeptide of the present invention having herein-mentioned cerotic acid, lignoceric acid and/or melissic acid increasing activity, e.g. of a polypeptide having the activity of a protein as indicated in table II, application no. 21, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned cerotic acid, lignoceric acid and/or melissic acid increasing activity, e.g. of a polypeptide having the activity of a protein as indicated in table II, application no. 21, columns 5 and 7 or its homologs activity; and/or e) stimulating activity of a protein conferring the increased expression of a protein encoded by the nucleic acid molecule of the present invention or a polypeptide of the present invention having herein-mentioned cerotic acid, lignoceric acid and/or melissic acid increasing activity, e.g. of a polypeptide having the activity of a protein as indicated in table II, application no. 21, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned cerotic acid, lignoceric acid and/or melissic acid increasing activity, e.g. of a polypeptide having the activity of a protein as indicated in table II, application no. 21, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned cerotic acid, lignoceric acid and/or melissic acid increasing activity, e.g. of a polypeptide having the activity of a protein as indicated in table II, application no. 21, columns 5 and 7 or its homologs activity; and/or h) increasing the expression of the endogenous gene encoding the polypeptide of the invention, e.g. a polypeptide having the activity of a protein as indicated in table II, application no. 21, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned cerotic acid, lignoceric acid and/or melissic acid increasing activity, e.g. of polypeptide having the activity of a protein as indicated in table II, application no. 21, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned cerotic acid, lignoceric acid and/or melissic acid increasing activity, e.g. of a polypeptide having the activity of a protein as indicated in table II, application no. 21, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned cerotic acid, lignoceric acid and/or melissic acid increasing activity, e.g. of a polypeptide having the activity of a protein as indicated in table II, application no. 21, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 21, column 3 or its homologs. Preferably the increase of the fine chemical takes place in plastids.

for the disclosure of the paragraphs [0069.0.0.20] to [0079.0.0.20] see paragraphs [0069.0.0.0] to [0079.0.0.0] above.

The activation of an endogenous polypeptide having above-mentioned activity, e.g. having the activity of a protein as shown in table II, application no. 21, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 21, column 3 and activates its transcription.

A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 21, column 3. The expression of the chimeric transcription factor in a organism, in particular in a plant, leads to a specific expression of the protein as shown in table II, application no. 21, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.20] to [0084.0.0.20] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. cerotic acid, lignoceric acid and/or melissic acid and mixtures thereof.

for the disclosure of this paragraph see paragraph [0086.0.0.0] above.

By influencing the metabolism thus, it is possible to produce, in the process according to the invention, further advantageous compounds. Examples of such compounds are, in addition to cerotic acid, lignoceric acid and/or melissic acid compounds such as other fatty acid such as palmitic acid, oleic acid, linoleic acid, linolenic acid, vitamins, amino acids or fatty acids.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 21, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate, other free or/and bound fatty acids such as myrisitic acid, palmitic acid, stearic acid, arachidic acid, oleic acid, linoleic acid, linolenic acid or erucic acid or mixtures thereof.

for the disclosure of the paragraphs [0090.0.0.20] to [0097.0.0.20] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 21, columns 5 and 7 or a derivative thereof, or
b) a genetic regulatory element, for example a promoter, which is functionally linked to the nucleic acid sequence as shown table I, application no. 21, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 21, columns 5 and 7 joined to a nucleic acid sequence encoding a transit peptide, or a targeting nucleic acid sequence which directs the nucleic acid sequences disclosed in table I, application no. 21, columns 5 and 7 to the organelle preferentially the plastids. Altenatively the inventive nucleic acids sequences consist advantageously of the nucleic acid sequences as depicted in the sequence protocol and disclosed in table I, application no. 21, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose cerotic acid, lignoceric acid and/or melissic acid content is modified advantageously owing to the nucleic acid molecule of the present invention expressed. This is important for plant breeders since, for example, the nutritional value of plants for animals is dependent on the abovementioned cerotic acid, lignoceric acid and/or melissic acid and the general amount of cerotic acid, lignoceric acid and/or melissic acid in feed. After the activity of the protein as shown in table II, application no. 21, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.20] [0110.0.0.20] see paragraphs [0102.0.0.0] to [0110.0.0.0] above.

In a preferred embodiment, the fine chemical (cerotic acid, lignoceric acid and/or melissic acid) is produced in accordance with the invention and, if desired, is isolated. The production of further fatty acids such as myrisitic acid, palmitic acid, stearic acid, arachidic acid, oleic acid, linoleic acid, linolenic acid or erucic acid and mixtures thereof or mixtures of other fatty acids by the process according to the invention is advantageous. It may be advantageous to increase the pool of free fatty acids such as cerotic acid, lignoceric acid and/or melissic acid and other as aforementioned in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example another gene of the cerotic acid, lignoceric acid and/or melissic acid biosynthesis, or a compound, which functions as a sink for the desired cerotic acid, lignoceric acid and/or melissic acid in the organism is useful to increase the production of the respective fine chemical.

In a preferred embodiment, the respective fine chemical is produced in accordance with the invention and, if desired, is isolated. The production of further fatty acids other than cerotic acid, lignoceric acid and/or melissic acid or compounds for which the respective fine chemical is a biosynthesis precursor compounds, e.g. shorter fatty acids such as acetic acid, amino acids, or mixtures thereof or mixtures of other fatty acids, in particular of cerotic acid, lignoceric acid and/or melissic acid, by the process according to the invention is advantageous.

In the case of the fermentation of microorganisms, the abovementioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fine chemical such as cerotic acid, lignoceric acid and/or melissic acid synthesized in the process according to the invention can advantageously be marketed directly without there being any need for the fine chemical synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

However, the respective fine chemical produced in the process according to the invention can also be isolated from the organisms, advantageously plants, (in the form of their organic extracts, e.g. alcohol, or other organic solvents or water containing extract and/or free cerotic acid, lignoceric acid and/or melissic acid or other extracts. The respective fine chemical produced by this process can be obtained by harvesting the organisms, either from the medium in which they grow, or from the field. This can be done via pressing or extraction of the plant parts. To increase the efficiency of extraction it is beneficial to clean, to temper and if necessary to hull and to flake the plant material. To allow for greater ease of disruption of the plant parts, specifically the seeds, they can previously be comminuted, steamed or roasted. Seeds, which have been pretreated in this manner can subsequently be pressed or extracted with solvents such as organic solvents like warm hexane or water or mixtures of organic solvents. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid.

Because cerotic acid, lignoceric acid and/or melissic acid in microorganisms are localized intracellular, their recovery essentially comes down to the isolation of the biomass. Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose.

Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose. However, it can be advantageous to avoid this treatment as it can result in cells devoid of most carotenoids.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 1127-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Cerotic acid, lignoceric acid and/or melissic acid can for example be analyzed advantageously via HPLC, LC or GC separation and MS (masspectrometry) detection methods. The unambiguous detection for the presence of behenic acid, lignoceric acid, cerotic acid or melissic acid containing products can be obtained by analyzing recombinant organisms using analytical standard methods: LC, LC-MS, MS or TLC). The material to be analyzed can be disrupted by sonication, grinding in a glass mill, liquid nitrogen and grinding, cooking, or via other applicable methods.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 21, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 21, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table III, application no. 21, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 21, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 21, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 21, columns 5 and 7 by one or more nucleotides. In one embodiment, the nucleic acid molecule used in the process of the invention does not consist of the sequence indicated in table IA, application no. 21, columns 5 and 7. In one embodiment, the nucleic acid molecule used in the process of the invention is less than 100%, 99.999%, 99.99%, 99.9% or 99% identical to a sequence indicated in table IA, application no. 21, columns 5 and 7. In another embodiment, the nucleic acid molecule does not encode a polypeptide of a sequence indicated in table IIA, application no. 21, columns 5 and 7.

In one embodiment, the nucleic acid molecule used in the process of the invention distinguishes over the sequence indicated in table IB, application no. 21, columns 5 and 7, by one or more nucleotides. In one embodiment, the nucleic acid molecule used in the process of the invention does not consist of the sequence indicated in table IB, application no. 21, columns 5 and 7. In one embodiment, the nucleic acid molecule used in the process of the invention is less than 100%, 99.999%, 99.99%, 99.9% or 99% identical to a sequence indicated in table IB, application no. 21, columns 5 and 7. In another embodiment, the nucleic acid molecule does not encode a polypeptide of a sequence indicated in table IIB, application no. 21, columns 5 and 7.

In one embodiment, the nucleic acid molecule used in the process distinguishes over the sequence shown in table I, application no. 21, columns 5 and 7 by one or more nucleotides or does not consist of the sequence shown in table I, application no. 21, columns 5 and 7. In one embodiment, the nucleic acid molecule of the present invention is less than 100%, 99.999%, 99.99%, 99.9% or 99% identical to the sequence shown in table I, application no. 21, columns 5 and 7. In another embodiment, the nucleic acid molecule does not encode a polypeptide of the sequence shown in table II, application no. 21, columns 5 and 7.

for the disclosure of the paragraphs [0118.0.0.20] to [0120.0.0.20] see paragraphs [0118.0.0.0] to [0120.0.0.0] above.

Nucleic acid molecules with the sequence shown in table I, application no. 21, columns 5 and 7, nucleic acid molecules which are derived from the amino acid sequences shown in table II, application no. 21, columns 5 and 7 or from polypeptides comprising the consensus sequence shown in table IV, application no. 21, column 7, or their derivatives or homologues encoding polypeptides with the enzymatic or biological activity of a protein as shown in table II, application no. 21, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 21, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 21, column 3 and conferring the fine chemical increase by expression either in the cytsol or in an organelle such as a plastid or mitochondria or both, preferably in plastids.

for the disclosure of the paragraphs [0126.0.0.20] to [0133.0.0.20] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 21, columns 5 and 7 or the functional homologues thereof as described herein, preferably conferring above-mentioned activity, i.e. conferring the fine chemical increase after increasing its activity, e.g. after increasing the activity of a protein as shown in table II, application no. 21, column 3 by for example expression either in the cytsol or in an organelle such as a plastid or mitochondria or both, preferably in plastids.

for the disclosure of the paragraphs [0135.0.0.20] to [0140.0.0.20] see paragraphs [0135.0.0.0] to [0140.0.0.0] above.

Synthetic oligonucleotide primers for the amplification, e.g. as shown in table III, application no. 21, column 7, by means of polymerase chain reaction can be generated on the basis of a sequence shown herein, for example the sequence shown in table I, application no. 21, columns 5 and 7 or the sequences derived from table II, application no. 21, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 21, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 21, column 3 or further functional homologs of the polypeptide of the invention from other organisms.

for the disclosure of the paragraphs [0144.0.0.20] to [0151.0.0.20] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 21, columns 5 and 7, preferably of table IB, application no. 21, columns 5 and 7 under relaxed hybridization conditions and which code on expression for peptides having the cerotic acid, lignoceric acid and/or melissic acid increasing activity.

for the disclosure of the paragraphs [0153.0.0.20] to [0159.0.0.20] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 21, columns 5 and 7, preferably shown in table IB, application no. 21, columns 5 and 7 is one which is sufficiently complementary to one of the nucleotide sequences shown in table I, application no. 21, columns 5 and 7, preferably shown in table IB, application no. 21, columns 5 and 7 such that it can hybridize to one of the nucleotide sequences shown in table I, application no. 21, columns 5 and 7, preferably shown in table IB, application no. 21, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 21, columns 5 and 7, preferably shown in table IB, application no. 21, columns 5 and 7, or a portion thereof and preferably has above mentioned activity, in particular having a fine chemical increasing activity after increasing the activity or an activity of a gene product as shown in table II, application no. 21, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 21, columns 5 and 7, preferably shown in table IB, application no. 21, columns 5 and 7, or a portion thereof and encodes a protein having above-mentioned activity, e.g. conferring of a cerotic acid, lignoceric acid and/or melissic acid increase by for example expression either in the cytsol or in an organelle such as a plastid or mitochondria or both, preferably in plastids, and optionally, the activity of a protein as shown in table II, application no. 21, column 3.

Moreover, the nucleic acid molecule of the invention can comprise only a portion of the coding region of one of the sequences shown in table I, application no. 21, columns 5 and 7, preferably shown in table IB, application no. 21, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 21, columns 5 and 7, an anti-sense sequence of one of the sequences, e.g., set forth in table I, application no. 21, columns 5 and 7, preferably shown in table IB, application no. 21, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table II, application no. 21, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 21, columns 5 and 7 such that the protein or portion thereof maintains the ability to participate in the fine chemical production, in particular a cerotic acid, lignoceric acid and/or melissic acid increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as amino acid residue in one of the sequences of the polypeptide of the present invention) to an amino acid sequence shown in table II, application no. 21, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 21, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.20] and [0169.0.0.20] see paragraphs [0168.0.0.0] and [0169.0.0.0] above.

The invention further relates to nucleic acid molecules that differ from one of the nucleotide sequences shown in table I, application no. 21, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 21, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 21, columns 5 and 7 or the functional homologues. In a still further embodiment, the nucleic acid molecule of the invention encodes a full length protein which is substantially homologous to an amino acid sequence shown in table II, application no. 21, columns 5 and 7 or the functional homologues. However, in a preferred embodiment, the nucleic acid molecule of the present invention does not consist of the sequence shown in table I, application no. 21, columns 5 and 7, preferably as indicated in table IA, application no. 21, columns 5 and 7. Preferably the nucleic acid molecule of the invention is a functional homologue or identical to a nucleic acid molecule indicated in table IB, application no. 21, columns 5 and 7.

for the disclosure of the paragraphs [0171.0.0.20] to [0173.0.0.20] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 21, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 21, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 21, columns 5 and 7.

for the disclosure of the paragraphs [0179.0.0.20] and [0180.0.0.20] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 21, columns 5 and 7, preferably shown in table IIA, application no. 21, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 21, columns 5 and 7, preferably shown in table IIA, application no. 21, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 21, columns 5 and 7, preferably shown in table IIA, application no. 21, columns 5 and 7, more preferably at least about 70% identical to one of the sequences shown in table II, application no. 21, columns 5 and 7, preferably shown in table IIA, application no. 21, columns 5 and 7, even more preferably at least about 80%, 90%, 95% homologous to the sequence shown in table II, application no. 21, columns 5 and 7, preferably shown in table IIA, application no. 21, columns 5 and 7, and most preferably at least about 96%, 97%, 98%, or 99% identical to the sequence shown in table II, application no. 21, columns 5 and 7, preferably shown in table IIA, application no. 21, columns 5 and 7.

for the disclosure of the paragraphs [0182.0.0.20] to [0188.0.0.20] see paragraphs [0182.0.0.0] to [0188.0.0.0] above.

Functional equivalents derived from one of the polypeptides as shown in table II, application no. 21, columns 5 and 7, preferably shown in table IIB, application no. 21, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 21, columns 5 and 7, preferably shown in table IIB, application no. 21, columns 5 and 7 resp., according to the invention and are distinguished by essentially the same properties as the polypeptide as shown in table II, application no. 21, columns 5 and 7, preferably shown in table IIB, application no. 21, columns 5 and 7.

Functional equivalents derived from the nucleic acid sequence as shown in table I, application no. 21, columns 5 and 7, preferably shown in table IB, application no. 21, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 21, columns 5 and 7, preferably shown in table IIB, application no. 21, columns 5 and 7 resp., according to the invention and encode polypeptides having essentially the same properties as the polypeptide as shown in table II, application no. 21, columns 5 and 7, preferably shown in table IIB, application no. 21, columns 5 and 7.

for the disclosure of this paragraph see paragraph [0191.0.0.0] above.

A nucleic acid molecule encoding an homologous to a protein sequence of table II, application no. 21, columns 5 and 7, preferably shown in table IIB, application no. 21, columns 5 and 7. resp., can be created by introducing one or more nucleotide substitutions, additions or deletions into a nucleotide sequence of the nucleic acid molecule of the present invention, in particular of table I, application no. 21, columns 5 and 7, preferably shown in table IB, application no. 21, columns 5 and 7 resp., such that one or more amino acid substitutions, additions or deletions are introduced into the encoded protein. Mutations can be introduced into the encoding sequences of table I, application no. 21, columns 5 and 7, preferably shown in table IB, application no. 21, columns 5 and 7 resp., by standard techniques, such as site-directed mutagenesis and PCR-mediated mutagenesis.

for the disclosure of the paragraphs [0193.0.0.20] to [0196.0.0.20] see paragraphs [0193.0.0.0] to [0196.0.0.0] above.

Homologues of the nucleic acid sequences used, with the sequence shown in table I, application no. 21, columns 5 and 7, preferably shown in table IB, application no. 21, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 21, columns 5 and 7, preferably shown in table IB, application no. 21, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 21, columns 5 and 7, preferably shown in table IB, application no. 21, columns 5 and 7. It is preferred that the nucleic acid molecule comprises as little as possible other nucleotides not shown in any one of table I, application no. 21, columns 5 and 7, preferably shown in table IB, application no. 21, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 21, columns 5 and 7, preferably shown in table IB, application no. 21, columns 5 and 7.

Also preferred is that the nucleic acid molecule used in the process of the invention encodes a polypeptide comprising the sequence shown in table II, application no. 21, columns 5 and 7, preferably shown in table IIB, application no. 21, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 21, columns 5 and 7, preferably shown in table IIB, application no. 21, columns 5 and 7.

In one embodiment, the nucleic acid molecule of the invention or used in the process encodes a polypeptide comprising the sequence shown in table II, application no. 21, columns 5 and 7, preferably shown in table IIB, application no. 21, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 21, columns 5 and 7, preferably shown in table IB, application no. 21, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 21, columns 5 and 7 expressed under identical conditions.

Homologues of table I, application no. 21, columns 5 and 7 or of the derived sequences of table II, application no. 21, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.20] to [0215.0.0.20] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 21, columns 5 and 7, preferably in table IIB, application no. 21, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 21, columns 5 and 7, preferably in table IB, application no. 21, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 21, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 21, column 7 and conferring an increase in the amount of the fine chemical in an organism or a part thereof;

k) nucleic acid molecule encoding the amino acid sequence of a polypeptide encoding a domain of the polypeptide shown in table II, application no. 21, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 21, columns 5 and 7 or a nucleic acid molecule encoding, preferably at least the mature form of, the polypeptide shown in table II, application no. 21, columns 5 and 7, and conferring an increase in the amount of the fine chemical in an organism or a part thereof; or which encompasses a sequence which is complementary thereto; whereby, preferably, the nucleic acid molecule according to (a) to (l) distinguishes over the sequence depicted in table I A and/or I β, application no. 21, columns 5 and 7 by one or more nucleotides. In one embodiment, the nucleic acid molecule of the invention does not consist of the sequence shown in table I A and/or I B, application no. 21, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 21, columns 5 and 7. In a further embodiment the nucleic acid molecule does not encode the polypeptide sequence shown in table II A and/or II B, application no. 21, columns 5 and 7. Accordingly, in one embodiment, the nucleic acid molecule of the present invention encodes in one embodiment a polypeptide which differs at least in one or more amino acids from the polypeptide shown in table II A and/or II B, application no. 21, columns 5 and 7 does not encode a protein of the sequence shown in table II A and/or II B, application no. 21, columns 5 and 7. Accordingly, in one embodiment, the protein encoded by a sequence of a nucleic acid according to (a) to (l) does not consist of the sequence shown in table I A and/or I B, application no. 21, columns 5 and 7. In a further embodiment, the protein of the present invention is at least 30% identical to protein sequence depicted in table II A and/or II B, application no. 21, columns 5 and 7 and less than 100%, preferably less than 99.999%, 99.99% or 99.9%, more preferably less than 99%, 985, 97%, 96% or 95% identical to the sequence shown in table IIA and/or IIB, application no. 21, columns 5 and 7.

for the disclosure of the paragraphs [0217.0.0.20] to [0226.0.0.20] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 21, columns 5 and 7 can be cloned 3' prime to the transitpeptide encoding sequence, leading to a functional pre-protein, which is directed to the plastids and which means that the mature protein fulfills its biological activity.

for the disclosure of the paragraphs [0228.0.0.20] to [0239.0.0.20] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 21, columns 5 and 7 or its derivatives, it is advantageous additionally to express and/or mutate further genes in the organisms. Especially advantageously, additionally at least one further gene of the fatty acid biosynthetic pathway is expressed in the organisms such as plants or microorganisms. Advantageously additional genes for the synthesis of cerotic acid, lignoceric acid and/or melissic acid are used. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 21, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the fatty acid metabolism, in particular in synthesis of cerotic acid, lignoceric acid and/or melissic acid. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the abovementioned biosynthesis genes are the sequences encoding further genes of the acetyl-CoA or malonyl-CoA metabolic pathway or a polypeptide having a very long chain fatty acid acyl (VLCFA) CoA synthase activity. It is also possible that the regulation of the natural genes has been modified advantageously so that the gene and/or its gene product is no longer subject to the regulatory mechanisms which exist in the organisms. This leads to an increased synthesis of fatty acids, fatty acids precursor or fatty acids metabolites, preferably cerotic acid, lignoceric acid and/or melissic acid, as desired since, for example, feedback regulations no longer exist to the same extent or not at all.

In a further advantageous embodiment of the process of the invention, the organisms used in the process are those in which advantageously simultaneously a cerotic acid, lignoceric acid and/or melissic acid degrading protein is attenuated, in particular by reducing the rate of expression of the corresponding gene, or by inactivating the gene for example the mutagenesis and/or selection. In another advantageous embodiment the synthesis of competitive pathways which rely on the same precursors are down regulated or interrupted.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemical and other fatty acids produced by this process can be obtained by harvesting the organisms, either from the crop in which they grow, or from the field. This can be done via for example pressing or extraction of the plant parts.

Preferably, the compound is a composition comprising the essentially pure cerotic acid, lignoceric acid and/or melissic acid or a recovered or isolated cerotic acid, lignoceric acid and/or melissic acid.

for the disclosure of the paragraphs [0243.0.0.20] to [0264.0.0.20] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide or transit-peptide-encoding sequences which are known per se. For example, plastid transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 21, columns 5 and 7 and described herein to achieve an expression in one of said compartments or extracellular.

for the disclosure of the paragraphs [0266.0.0.20] to [0287.0.0.20] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 21, columns 5 and 7 or their homologs is functionally linked to a plastidial targeting sequence. A further preferred embodiment of the invention relates to a vector in which a nucleic acid sequence encoding one of the polypeptides shown in table II, application no. 21, columns 5 and 7 or their homologs is functionally linked to a regulatory sequences which permit the expression in plastids.

for the disclosure of the paragraphs [0289.0.0.20] to [0296.0.0.20] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b1228, anti-b2207, anti-b2965, anti-b3568, anti-YDR035W and/or anti-YLR153C protein antibody or an antibody against polypeptides as shown in table II, application no. 21, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 21, columns 5 and 7 or as coded by the nucleic acid molecule shown in table I, application no. 21, columns 5 and 7 or functional homologues thereof.

In one advantageous embodiment, in the method of the present invention the activity of a polypeptide is increased comprising or consisting of the consensus sequence shown in table IV, application no. 21, columns 7 and in one another embodiment, the present invention relates to a polypeptide comprising or consisting of the consensus sequence shown in table IV, application no. 21, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.20] to [0304.0.0.20] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 21, columns 5 and 7 by one or more amino acids. In one embodiment, polypeptide distinguishes form the sequence shown in table IIA and/or IIB, application no. 21, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 21, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 21, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 21, columns 5 and 7 by one or more amino acids. In another embodiment, said polypeptide of the invention does not consist of the sequence shown in table IIA and/or IIB, application no. 21, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 21, columns 5 and 7.

In one embodiment, the present invention relates to a polypeptide having the activity of the protein as shown in table IIA and/or IIB, application no. 21, column 3, which distinguishes over the sequence depicted in table IIA and/or IIB, application no. 21, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.20] to [0311.0.0.20] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 21, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 21, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 21, columns 5 and 7 or which is homologous thereto, as defined above.

Accordingly the polypeptide of the present invention can vary from the sequences shown in table IIA and/or IIB, application no. 21, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 21, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 21, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 21, column 3. Differences shall mean at least one amino acid different from the sequences as shown in table II, application no. 21, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 21, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 21, column 3. The nucleic acid molecules and polypeptide molecules of the invention are expressed such that the yield, production, and/or efficiency of production of a desired compound is improved.

for the disclosure of the paragraphs [0320.0.0.20] to [0322.0.0.20] see paragraphs [0320.0.0.0] to [0322.0.0.0] above.

In one embodiment, a protein (=polypeptide) as shown in table II, application no. 21, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 21, column 3, e.g., a protein which does not confer the activity described herein and which is derived from the same or a different organism.

for the disclosure of the paragraphs [0324.0.0.20] to [0329.0.0.20] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 21, columns 5 and 7.

for the disclosure of the paragraphs [0331.0.0.20] to [0346.0.0.20] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 21, column 3. Due to the above mentioned activity the fine chemical content in a cell or an organism is increased. For example, due to modulation or manupulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 21, column 3 or a protein as shown in table II, application no. 21, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 21, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.20] to [0358.0.0.20] see paragraphs [0350.0.0.0] to [0358.0.0.0] above.

Transgenic plants comprising cerotic acid, lignoceric acid and/or melissic acid or mixtures thereof synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue.

The cerotic acid, lignoceric acid and/or melissic acid produced in the process according to the invention may, however, also be isolated from the plant in the form of their free cerotic acid, lignoceric acid and/or melissic acid produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, cosmetics, pharmaceuticals or fine chemicals.

for the disclosure of the paragraphs [0360.0.0.20] to [0362.0.0.20] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the cerotic acid, lignoceric acid and/or melissic acid produced in the process can be isolated. The resulting fine chemical can, if appropriate, subsequently be further purified, if desired mixed with other active ingredients such as other xanthophylls, fatty acids, vitamins, amino acids, carbohydrates, antibiotics and the like, and, if appropriate, formulated.

In one embodiment, cerotic acid, lignoceric acid and/or melissic acid is the fine chemical.

The cerotic acid, lignoceric acid and/or melissic acid, in particular the respective fine chemicals obtained in the process are suitable as starting material for the synthesis of further products of value. For example, they can be used in combination with each other or alone for the production of pharmaceuticals, health products, foodstuffs, animal feeds, nutrients or cosmetics. Accordingly, the present invention relates a method for the production of pharmaceuticals, health products, food stuff, animal feeds, nutrients or cosmetics comprising the steps of the process according to the invention, including the isolation of the cerotic acid, lignoceric acid and/or melissic acid containing, in particular cerotic acid, lignoceric acid and/or melissic acid containing composition produced or the respective fine chemical produced if desired and formulating the product with a pharmaceutical acceptable carrier or formulating the product in a form acceptable for an application in agriculture. A further embodiment according to the invention is the use of the cerotic acid, lignoceric acid and/or melissic acid produced in the process or of the transgenic organisms in animal feeds, foodstuffs, medicines, food supplements, cosmetics or pharmaceuticals.

for the disclosure of the paragraphs [0366.0.0.20] to [0369.0.0.20] see paragraphs [0366.0.0.0] to [0369.0.0.0] above.

The fermentation broths obtained in this way, containing in particular cerotic acid, lignoceric acid and/or melissic acid in mixtures with other organic acids, amino acids, polypeptides or polysaccharides, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the cerotic acid, lignoceric acid and/or melissic acid, in particular the cerotic acid, lignoceric acid and/or melissic acid produced according to the invention further. For this purpose, the product-containing composition, e.g. a total or partial extraction fraction using organic solvents, is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.20] to [0376.0.0.20], [0376.1.0.20] and [0377.0.0.20] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting-; e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 21, columns 5 and 7, preferably in table IB, application no. 21, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.20] to [0383.0.0.20] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 21, column 3, e.g. comparing near identical organisms with low and high activity of the proteins as shown in table II, application no. 21, column 3.

for the disclosure of the paragraphs [0385.0.0.20] to [0404.0.0.20] see paragraphs [0385.0.0.0] to [0404.0.0.0] above.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other fatty acids, in particular fatty acids such as myrisitic acid, palmitic acid, stearic acid, arachidic acid, oleic acid, linoleic acid, linolenic acid or erucic acid.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the fine chemical in an organism or part thereof, e.g. in a cell.

for the disclosure of the paragraphs [0406.0.0.20] to [0435.0.0.20] see paragraphs [0406.0.0.0] to [0435.0.0.0] above.

Production of Cerotic Acid, Lignoceric Acid and/or Melissic Acid in *Chlamydomonas reinhardtii*

The cerotic acid, lignoceric acid and/or melissic acid production can be analysed as mentioned herein.

The proteins and nucleic acids can be analysed as mentioned below.

In addition a production in other organisms such as plants or microorganisms such as yeast, *Mortierella alpina*, *Corynebacterium glutamicum* or *Escherichia coli* is possible.

for the disclosure of the paragraphs [0437.0.0.20] and [0438.0.0.20] see paragraphs [0437.0.0.0] and [0438.0.0.0] above.

Example 9

Analysis of the Effect of the Nucleic Acid Molecule on the Production of Cerotic Acid, Lignoceric Acid and/or Melissic Acid The effect of the genetic modification of plants or algae on the production of a desired compound (such as cerotic acid, lignoceric acid and/or melissic acid) can be determined by growing the modified plant under suitable conditions (such as those described above) and analyzing the medium and/or the cellular components for the elevated production of desired product (i.e. of cerotic acid, lignoceric acid and/or melissic acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter II, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of and Determination of the Cerotic Acid, Lignoceric Acid and/or Melissic Acid Content:

Abbreviations: GC-MS, gas liquid chromatography/mass spectrometry; TLC, thin-layer chromatography.

The unambiguous detection for the presence of xanthophylls can be obtained by analyzing recombinant organisms using analytical standard methods: LC, LC-MSMS or TLC, as described The total cerotic acid, lignoceric acid and/or melissic acid produced in the organism for example in algae used in the inventive process can be analysed for example according to the following procedure:

The material such as algae or plants to be analyzed can be disrupted by sonication, grinding in a glass mill, liquid nitrogen and grinding or via other applicable methods. Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, separation of non-polar epiphase from more polar hypophasic derivatives and chromatography. E.g.:

For analysis, solvent delivery and aliquot removal can be accomplished with a robotic system comprising a single injector valve Gilson 232XL and a 4022S1V diluter [Gilson, Inc. USA, 3000 W. Beltline Highway, Middleton, Wis.]. For saponification, 3 ml of 50% potassium hydroxide hydro-ethanolic solution (4 water:1 ethanol) can be added to each vial, followed by the addition of 3 ml of octanol. The saponification treatment can be conducted at room temperature with vials maintained on an IKA HS 501 horizontal shaker [Labworld-online, Inc., Wilmington, N.C.] for fifteen hours at 250 movements/minute, followed by a stationary phase of approximately one hour.

Following saponification, the supernatant can be diluted with 0.10 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol: 4 water: 15 tetrahydrofuran (THF) stabilized with 0.2% BHT (2,6-di-tert-butyl-4-methylphenol). Injections were 20 µl. Separation can be isocratic at 30° C. with a flow rate of 1.7 ml/minute. The peak responses can be measured by absorbance at 447 nm.

One example is the analysis of the fatty acids. The unambiguous detection for the presence of the fatty acid products can be obtained by analyzing recombinant organisms using analytical standard methods, especially HPLC with UV or electrochemical detection as for example described in The Journal of Lipid Research, Vol. 39, 2099-2105, 1998.

Plant material is initially homogenized mechanically by comminuting in a pestle and mortar to make it more amenable to extraction.

for the disclosure of the paragraphs [0446.0.0.20] to [0496.0.0.20] see paragraphs [0446.0.0.0] to [0496.0.0.0] above.

Usually acetone or hexane is used for the extraction of the fatty acids and further purification is achieved either by column chromatography with a suitable resin.

If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

The results of the different plant analyses can be seen from the table, which follows:

TABLE VI

| ORF | Metabolite | Method | Min | Max |
|---|---|---|---|---|
| b1228 | Cerotic acid (C26:0) | GC | 1.43 | 2.37 |
| b2207 | Cerotic acid (C26:0) | GC | 1.41 | 1.55 |
| b2965 | Cerotic acid (C26:0) | GC | 1.55 | 2.91 |
| b3568 | Lignoceric acid (C24:0) | GC | 1.31 | 2.34 |
| YDR035W | Lignoceric acid (C24:0) | GC | 1.53 | 2.26 |
| YDR035W | Melissic Acid (C30:0) | GC | 1.30 | 1.75 |
| YLR153C | Lignoceric acid (C24:0) | GC | 1.44 | 1.53 | for the disclosure of the paragraphs [0499.0.0.20] and [0500.0.0.20] see paragraphs [0499.0.0.0] and [0500.0.0.0] above.

Example 15a

Engineering Ryegrass Plants by Over-Expressing b1228 from *Escherichia coli* or Homologs of b1228 from Other Organisms for the disclosure of the paragraphs [0502.0.0.20] to [0508.0.0.20] see paragraphs [0502.0.0.0] to [0508.0.0.0] above.

Example 15b

Engineering Soybean Plants by Over-Expressing b1228 from *Escherichia coli* or Homologs of b1228 from Other Organisms for the disclosure of the paragraphs [0510.0.0.20] to [0513.0.0.20] see paragraphs [0510.0.0.0] to [0513.0.0.0] above.

Example 15c

Engineering Corn Plants by Over-Expressing b1228 from *Escherichia coli* or Homologs of b1228 from Other Organisms for the disclosure of the paragraphs [0515.0.0.20] to [0540.0.0.20] see paragraphs [0515.0.0.0] to [0540.0.0.0] above.

Example 15d

Engineering Wheat Plants by Over-Expressing b1228 from *Escherichia coli* or Homologs of b1228 from Other Organisms for the disclosure of the paragraphs [0542.0.0.20] to [0544.0.0.20] see paragraphs [0542.0.0.0] to [0544.0.0.0] above.

Example 15e

Engineering Rapeseed/Canola Plants by Over-Expressing b1228 from *Escherichia coli* or Homologs of b1228 from Other Organisms for the disclosure of the paragraphs [0546.0.0.20] to [0549.0.0.20] see paragraphs [0544.0.0.0] to [0549.0.0.0] above.

Example 15f

Engineering Alfalfa Plants by Over-Expressing b1228 from *Escherichia coli* or Homologs of b1228 from Other Organisms for the disclosure of the paragraphs [0551.0.0.20] to [0554.0.0.20] see paragraphs [0551.0.0.0] to [0554.0.0.0] above.

Example 16

Metabolite Profiling Info from *Zea mays*

*Zea mays* plants were engineered as described in Example 15c.

Metabolic results were either obtained from regenerated primary transformants (T0) or from the following progeny generation (T1) in comparison to appropriate control plants. The results are shown in table VII

TABLE VII

| ORF_NAME | Metabolite | MIN | MAX |
|---|---|---|---|
| YDR035W | Lignoceric acid (C24:0) | 1.27 | 1.76 |

Table VII shows the increase in lignoceric acid in genetically modified corn plants expressing the *Saccharomyces cerevisiae* nucleic acid sequence YDR035W.

In one embodiment, in case the activity of the *Saccharomyces cerevisiae* YDR035W or its homologs, e.g. a "3-deoxy-D-arabino-heptulosonate 7-phosphate (DAHP) synthase", is increased in corn plants, preferably, an increase of the fine chemical lignoceric acid between 27% and 76% or more is conferred.

for the disclosure of this paragraph see [0554.2.0.0] above.
for the disclosure of this paragraph see [0555.0.0.0] above.
for the disclosure of this paragraph see [0001.0.0.0].

Plants produce glycerol and glycerol-3-phosphate. Importantly lipids derived from glycerol are the major components of eukaryotic cells. In terms of dry weight they account for anywhere between 10% and 90% of the total mass of the cell. Triglycerol are the major source of store energy in eucaryotic organisms.

Glycerol-3-phosphate can be synthesized via two different routes in plants. In one route, it is formed from dihydroxyacetone phosphate (DHAP), an intermediate of glycolysis, by the sequential action of triosephosphate isomerase, glyceraldehyde-phosphate phosphatase, glyeraldehyde reductase and glycerol kinase. The last enzyme of this pathway has been suggested as the rate-limiting step of this route for glycerol-3phosphate synthesis. In an second pathway glycerol-3-phosphate dehydrogenase (NAD(+)-G-3-P oxidoreductase, EC 1.1.1.8) (GPDH) catalyses the reduction of dihydroxyacetone phosphate (DHAP) to form glycerol-3-phosphate (G-3-P). Based on enzymatic studies is has been suggested that this enzyme activity is probably the primary source of glycerol-3-phosphate at least in *Brassica campestris* seeds (Sharma et al., 2001, Plant Sci 160, 603-610).

In plants, at least two types of GPDH, a cytoplasmatic and a plastidial exist, which also differ in their reducing cosubstrate. The cytsolic GPDH uses NADH as the cosubstrate. The mitochondrial FAD-dependent glycerol-3-phosphate dehydrogenase (FAD-GPDH) of *Arabidopsis* forms a G-3-P shuttle, as previously established in other eukaryotic organisms, and links cytosolic G-3-P metabolism to carbon source utilization and energy metabolism in plants—also see Shen, W. et al., FEBS Lett. 2003 Feb. 11; 536(1-3): 92-6.

Glycerol-insensitive *Arabidopsis* mutants: gli1 seedlings lack glycerol kinase, accumulate glycerol and are more resistant to abiotic stress, see Eastmond P. J., ☐ HYPERLINK "http://www.ingentaconnect.com/content/bsc/tpj"\o "The Plant Journal" ☐The Plant Journal☐, 2004, 37(4), 617-625. These data show that glycerol kinase is required for glycerol catabolism in *Arabidopsis* and that the accumulation of glycerol can enhance resistance to a variety of abiotic stresses associated with dehydration.

The major storage lipids (or oils) of seeds occur in the form of triacylglycerols (TAG), or three fatty acids linked to glycerol by ester bonds. Triacylglycerol synthesis involves diverse cellular compartments, including the cytoplasm, the mitochondria, the plastids, and the endoplasmic reticulum (ER). Glycerol-3-phosphate enters the ER for the final step in triacylglycerol synthesis. The newly formed triacylglycerols accumulate between the two layers of the double membrane of the ER, forming an oil body surrounded by a single (or half) unit membrane.

Glycerol-3-phosphate acyltransferase (GPAT) is one of the most important enzymes in TAG biosynthesis, since it initiates TAG synthesis by catalyzing the acylation of the Sn-1 position of Sn-glycerol-3-phosphate, producing Sn-1-acylglycerol-3-phosphate. Lyso-phosphatidic acid (LPA) is then acetylated by LPA acyl-transferases to produce phosphatidic acid (PA). Then diacylglycerol (DAG) is released through the dephosphorylation of PA by PA phosphohydrolase. Finally DAG becomes acylated by the activity of the DAG acyltransferase. In a second pathway phosphatidylcholine (PC) is formed and its acyl residues are desaturated further. The choline phosphate residue is then liberated by hydrolysis and the corresponding DAG acylated. This second pathway operates frequently in the synthesis of highly unsaturated TAG (Heldt 1997, Plant biochemistry and molecular biology. Oxford University Press, New York).

Additionally at present, many researches have proved that the GPAT is related to plant chilling-resistance, see Liu, Ji-Mei et al., Plant Physiol. 120(1999): 934.

Glycerol-3-phosphate is a primary substrate for triacylglycerol synthesis. Vigeolas and Geigenberger (Planta 219 (2004): 827-835) have shown that injection of developing seeds with glycerol leads to increased glycerol-3-phosphate levels. These increased levels of glycerol-3-phosphate were accompanied by an increase in the flux of sucrose into total lipids and triacylglycerol providing evidence that the prevailing levels of glycerol-3-phosphate co-limit triacylglycerol production in developing seeds.

The direct acylation of glycerol by a glycerol: acyl-CoA acyltransferase to form monoacyl-glycerol and, subsequently, diacylglycerol and triacylglycerol has been shown in myoblast and hepatocytes (Lee, D. P. et al. J. Lipid res. 42 (2001): 1979-1986). This direct acylation became more prominent when the glycerol-3-phosphate pathway was attenuated or when glycerol levels become elevated.

Glycerol is used together with water and alcohol (ethyl alcohol) in glycerinated water/alcohol plant extracts and phytoaromatic compounds. These products are used as food supplements, providing concentrates of the minerals, trace elements, active ingredients (alkaloids, polyphenols, pigments, etc.) and aromatic substances to be found in plants. Glycerin acts as a carrier for plant extracts. It is found in the end product (the fresh plant extract) in concentrations of up to 24% or 25%.

Raw glycerol is a by-product of the transesterification process of rape oil to rape methyl ester (RME) and used edible oil to used edible methyl ester (AME), both better known as Biodiesel.

Glycerol world production is estimated to be around 750.000 t/year. Around 90% is manufactured on the basis of natural oils and fats.

The green alga *Dunaliella*, for example, recently has been established in mass culture as a commercial source for glycerol. *Dunaliella* withstands extreme salinities while maintaining a low intracellular salt concentration. Osmotic adjustment is achieved by intracellular accumulation of glycerol to a level counterbalancing the external osmoticum.

The osmoregulatory isoform of dihydroxyacetone phosphate (DHAP) reductase (OsmDHAPR) is an enzyme unique to *Dunaliella tertiolecta* and is the osmoregulatory isoform involved in the synthesis of free glycerol for osmoregulation in extreme environments, such as high salinity, see Ghoshal, D., et al., Protein Expression and Purification, 2002, 24, (3), 404-411.

A unsolved problem in plant biochemistry is the understanding of metabolic regulation of glycerol-3-phosphate synthesis and its use in modifying glyceride metabolism or glycerol production. Practically it will have significance for rationally genetically engineering of plants for increased synthesis of triacylglycerols or for other value added products, and for introducing the glycerol synthesis capability into plants of economic importance for an elevated environmental stress tolerance—see: Durba, G. et al., J. Plant Biochemistry & Biotechnology 10(2001), 113-120.

One way to increase the productive capacity of biosynthesis is to apply recombinant DNA technology. Thus, it would be desirable to produce glycerol and/or glycerol-3-phosphate in plants. That type of production permits control over quality, quantity and selection of the most suitable and efficient producer organisms. The latter is especially important for commercial production economics and therefore availability to consumers. In addition it is desirable to produce glycerol and/or glycerol-3-phosphate in plants in order to increase plant productivity and resistance against biotic and abiotic stress as discussed before.

Thus, it would be advantageous if an algae, plant or other microorganism were available which produce large amounts of glycerol and/or glycerol-3phosphate. The invention discussed hereinafter relates in some embodiments to such transformed prokaryotic or eukaryotic microorganisms.

It would also be advantageous if plants were available whose roots, leaves, stem, fruits or flowers produced large amounts of glycerol and/or glycerol-3-phosphate. The invention discussed hereinafter relates in some embodiments to such transformed plants.

Furthermore it would be advantageous if plants were available whose seed produced larger amounts of total lipids. The invention discussed hereinafter relates in some embodiments to such transformed plants.

One way to increase the productive capacity of biosynthesis is to apply recombinant DNA technology. Thus, it would be desirable to produce glycerol and/or glycerol-3-phosphate in plants. That type of production permits control over quality, quantity and selection of the most suitable and efficient producer organisms. The latter is especially important for commercial production economics and therefore availability to consumers. In addition it is desirable to produce glycerol and/or glycerol-3-phosphate in plants in order to increase plant productivity and resistance against biotic and abiotic stress as discussed before.

Therefore improving the productivity of said glycerol and/or glycerol-3-phosphate and improving the quality of cosmetics, pharmaceuticals, foodstuffs and animal feeds, in particular of nutrition supplements, is an important task of the different industries.

To ensure a high productivity of glycerol and/or glycerol-3-phosphate in plants or microorganism, it is necessary to manipulate the natural biosynthesis of glycerol and/or glycerol-3-phosphate in said organisms.

Thus, it would be advantageous if an algae, plant or other microorganism were available which produce large amounts glycerol and/or glycerol-3-phosphate. The invention discussed hereinafter relates in some embodiments to such transformed prokaryotic or eukaryotic microorganisms.

It would also be advantageous if plants were available whose roots, leaves, stem, fruits or flowers produced large amounts of glycerol and/or glycerol-3-phosphate. The invention discussed hereinafter relates in some embodiments to such transformed plants.

Accordingly, there is still a great demand for new and more suitable genes which encode enzymes or other regulators which participate in the biosynthesis of glycerol and/or glycerol-3-phosphate and make it possible to produce glycerol and/or glycerol-3-phosphate specifically on an industrial scale without that unwanted byproducts are formed. In the selection of genes for biosynthesis two characteristics above all are particularly important. On the one hand, there is as ever a need for improved processes for obtaining the highest possible contents of glycerol and/or glycerol-3phosphate on the other hand as less as possible byproducts should be produced in the production process.

Furthermore there is still a great demand for new and more suitable genes, which encode enzymes or other proteins, which participate in the biosynthesis of total lipids and make it possible to produce them specifically on an industrial scale without unwanted byproducts forming. In the selection of genes for biosynthesis two characteristics above all are particularly important. On the one hand, there is as ever a need for improved processes for obtaining the highest possible contents of total lipids and especially of glycerol and/or glycerol-3-phosphate; on the other hand as less as possible byproducts should be produced in the production process.

Glycerol or glycerol-3-phosphate is biosynthetic precursor for the biosynthesis of monoacylglycerols, diacylglycerols, triacylglycerols, phosphatidylglycerols and other glycerolipids (e.g. glycosylglycerides, diphosphatidylglycerols, phosphonolipids, phosphatidylcholines, phosphatidylethanolamines, phosphatidylinositols, phytoglycolipids). Therefore the analysis of the glycerol content in cells, tissues or plant parts like seeds and leaves after total lipid extraction and lipid hydrolysis directly correlates with the analysis of the total lipid content. For example if the overexpression of a gene participating in the biosynthesis of triacylglycerols in the seed results in an increase in total lipid content in the seed or leaf this seed will also show an increased glycerol content after total lipid extraction and hydrolysis of the lipids.

Therefore the method as described below which leads to an increase in glycerol in the lipid fraction after cleavage of the ester functions for example with a mixture of methanol and hydrochloric acid clearly represents a method for an increased production of triacylglycerol or total lipids.

for the disclosure of this paragraph see [0013.0.0.0] above.

Accordingly, in a first embodiment, the invention relates to a process for the production of a fine chemical, whereby the fine chemical is glycerol and/or glycerol-3-phosphate in free or bound form for example bound to lipids, oils or fatty acids. Accordingly, in the present invention, the term "the fine chemical" as used herein relates to "glycerol and/or glycerol-3-phosphate in free or bound form". Further, the term "the fine chemicals" as used herein also relates to fine chemicals comprising glycerol and/or glycerol-3-phosphate in free or bound form.

In one embodiment, the term "glycerol and/or glycerol-3-phosphate in free or bound form", "the fine chemical" or "the respective fine chemical" means at least one chemical compound selected from the group consisting of glycerol and/or glycerol-3-phosphate, its salts, ester, thioester or mixtures thereof in free or bound form. Throughout the specification the term "the fine chemical" or "the respective fine chemical" means a compound selected from the group glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugarpolymers, like glucosides or polyols like myo-inositol or mixtures thereof. In one embodiment, the term "the fine chemical" and the term "the respective fine chemical" mean at least one chemical compound with an activity of the abovementioned fine chemical.

In one embodiment, the term "the fine chemical" means monoacylglycerols, diacylglycerols, triacylglycerols, phosphatidylglycerols and/or other glycerolipids (e.g. but not limited to glycosylglycerides, diphosphatidylglycerols, phosphonolipids, phosphatidylcholines, phosphatidylethanolamines, phosphatidylinositols or phytoglycolipids) and is hereinafter referred to as "total lipids".

Accordingly, the present invention relates to a process for the production of glycerol and/or glycerol-3-phosphate, which comprises
(a) increasing or generating the activity of a protein as shown in table II, application no. 22, column 3 encoded by the nucleic acid sequences as shown in table I, application no. 22, column 5, in an organelle of a microorganism or plant, or
(b) increasing or generating the activity of a protein as shown in table II, application no. 22, column 3 encoded by the nucleic acid sequences as shown in table I, application no. 22, column 5 in the plastid of a microorganism or plant, or in one or more parts thereof; and
(c) growing the organism under conditions which permit the production of the fine chemical, thus, glycerol and/or glycerol-3-phosphate or fine chemicals comprising glycerol and/or glycerol-3-phosphate, are produced in said organism or in the culture medium surrounding the organism.

Accordingly, the term "the fine chemical" means "glycerol and/or glycerol-3-phosphate, its salts, ester, thioester or mixtures thereof in free or bound form" in relation to all sequences listed in table I, application no. 22, columns 3 and 7 or homologs thereof. Accordingly, the term "the fine chemical" can mean "glycerol and/or glycerol-3-phosphate in free or bound form", owing to circumstances and the context. Preferably the term "the fine chemical" means "glycerol and/or glycerol-3-phosphate". In order to illustrate that the meaning of the term "the respective fine chemical" means "glycerol and/or glycerol-3-phosphate in free or bound form" owing to the sequences listed in the context the term "the respective fine chemical" is also used.

In another embodiment the present invention is related to a process for the production of glycerol and/or glycerol-3-phosphate, which comprises
(a) increasing or generating the activity of a protein as shown in table II, application no. 22, column 3 encoded by the nucleic acid sequences as shown in table I, application no. 22, column 5, in an organelle of a non-human organism, or
(b) increasing or generating the activity of a protein as shown in table II, application no. 22, column 3 encoded by the nucleic acid sequences as shown in table I, application no. 22, column 5, which are joined to a nucleic acid sequence encoding a transit peptide in a non-human organism, or in one or more parts thereof; or
(c) increasing or generating the activity of a protein as shown in table II, application no. 22, column 3 encoded by the nucleic acid sequences as shown in table I, application no. 22, column 5, which are joined to a nucleic acid sequence encoding chloroplast localization sequence, in a non-human organism, or in one or more parts thereof, and
(d) growing the organism under conditions which permit the production of glycerol and/or glycerol-3-phosphate in said organism.

In another embodiment, the present invention relates to a process for the production of glycerol and/or glycerol-3-phosphate, which comprises
(a) increasing or generating the activity of a protein as shown in table II, application no. 22, column 3 encoded by the nucleic acid sequences as shown in table I, application no. 22, column 5, in an organelle of a microorganism or plant through the transformation of the organelle, or
(b) increasing or generating the activity of a protein as shown in table II, application no. 22, column 3 encoded by the nucleic acid sequences as shown in table I, application no. 22, column 5 in the plastid of a microorganism or plant, or in one or more parts thereof through the transformation of the plastids; and
(c) growing the organism under conditions which permit the production of the fine chemical, thus, glycerol and/or glycerol-3-phosphate or fine chemicals comprising glycerol and/or glycerol-3-phosphate in said organism or in the culture medium surrounding the organism.

Advantagously the activity of the protein as shown in table II, application no. 22, column 3 encoded by the nucleic acid sequences as shown in table I, application no. 22, column 5 is increased or generated in the abovementioned process in the plastid of a microorganism or plant.

for the disclosure of the paragraphs [0019.0.0.21] to [0024.0.0.21] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 22, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase.

The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 22, column 3 and its homologs as disclosed in table I, application no. 22, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 22, column 3 and its homologs as disclosed in table I, application no. 22, columns 5 and 7.

for the disclosure of the paragraphs [0027.0.0.21] to [0029.0.0.21] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 22, columns 5 and 7. The person skilled in the art is able to join said sequences in a functional manner. Advantageously the transit peptide part is cleaved off from the protein part shown in table II, application no. 22, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 22, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 22, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 22, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 22, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 22, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.21] and [0030.3.0.21] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 22, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 22, columns 5 and 7 or a sequence encoding a protein, as depicted in table II, application no. 22, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 22, columns 5 and 7 or a sequence encoding a protein, as depicted in table II, application no. 22, columns 5 and 7 in such a manner that the viroid sequence transports a sequence transcribed from a sequence as depicted in table I, application no. 22, columns 5 and 7 or a sequence encoding a protein as depicted in table II, application no. 22, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 22, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 22, columns 5 and 7.

In a preferred embodiment of the invention the nucleic acid sequences as shown in table I, application no. 22, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 22, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.21] and [0032.0.0.21] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 22, column 3. Preferably the modification of the activity of a protein as shown in table II, application no. 22, column 3 or their combination can be achieved by joining the protein to a transit peptide.

Surprisingly it was found, that the transgenic expression of the *Saccaromyces cerevisiae* protein as shown in table II, application no. 22, column 3 in plastids of a plant such as *Arabidopsis thalaiana* for example through the linkage to at least one targeting sequence for example as mentioned in table V conferred an increase in the fine chemical content of the transformed plants.

for the disclosure of this paragraph see paragraph [0035.0.0.0] above.

The sequence of b0342 (Accession number XXECTG) from *Escherichia coli* has been published in Blattner et al., Science 277 (5331), 1453-1474 (1997), and its activity is being defined as "thiogalactoside acetyltransferase". Accordingly, in one embodiment, the process of the present invention comprises the use of a "thiogalactoside acetyltransferase" or its homolog, e.g. as shown herein, for the production of the fine chemical, meaning of glycerol and/or glycerol-3-phosphate, in particular for increasing the amount of glycerol and/or glycerol-3-phosphate in free or bound form in an organism or a part thereof, as mentioned. In one embodiment, in the process of the present invention the activity of a b0342 protein is increased or generated, e.g. from *Escherichia coli* or a homolog thereof, preferably linked at least to one transit peptide as mentioned for example in table V.

In another embodiment, in the process of the present invention the activity of a b0342 protein is increased or generated in a subcellular compartment of the organism or organism cell such as in an organelle like a plastid or mitochondria.

The sequence of b1021 (Accession number C64844) from *Escherichia coli* has been published in Blattner et al., Science 277 (5331), 1453-1474 (1997), and its activity is being defined as "proberly membrane protein ycdP". Accordingly, in one embodiment, the process of the present invention comprises the use of a "proberly membrane protein ycdP" or its homolog, e.g. as shown herein, for the production of the fine chemical, meaning of glycerol and/or glycerol-3-phosphate, in particular for increasing the amount of glycerol and/or glycerol-3-phosphate in free or bound form in an organism or a part thereof, as mentioned. In one embodiment, in the process of the present invention the activity of a b1021 protein is increased or generated, e.g. from *Escherichia coli* or a homolog thereof, preferably linked at least to one transit peptide as mentioned for example in table V.

In another embodiment, in the process of the present invention the activity of a b1021 protein is increased or generated in a subcellular compartment of the organism or organism cell such as in an organelle like a plastid or mitochondria.

The sequence of b2022(Accession number NP_416526) from *Escherichia coli* has been published in Blattner et al., Science 277 (5331), 1453-1474 (1997), and its activity is being defined as "bifunctional histidinol-phosphatase/imidazoleglycerol-phosphate dehydratase". Accordingly, in one embodiment, the process of the present invention comprises the use of a "bifunctional histidinol-phosphatase/imidazoleglycerol-phosphate dehydratase" or its homolog, e.g. as shown herein, for the production of the fine chemical, meaning of glycerol and/or glycerol-3-phosphate, in particular for increasing the amount of glycerol and/or glycerol-3-phosphate in free or bound form in an organism or a part thereof, as mentioned. In one embodiment, in the process of the present invention the activity of a b2022 protein is increased or generated, e.g. from *Escherichia coli* or a homolog thereof, preferably linked at least to one transit peptide as mentioned for example in table V.

In another embodiment, in the process of the present invention the activity of a b2022 protein is increased or generated in a subcellular compartment of the organism or organism cell such as in an organelle like a plastid or mitochondria.

The sequence of b2818 (Accession number NP_417295) from *Escherichia coli* has been published in Blattner et al., Science 277 (5331), 1453-1474 (1997), and its activity is being defined as "N-acetylglutamate synthase (amino acid N-acetyltransferase)". Accordingly, in one embodiment, the process of the present invention comprises the use of a "N-acetylglutamate synthase (amino acid N-acetyltransferase)" or its homolog, e.g. as shown herein, for the production of the fine chemical, meaning of glycerol and/or glycerol-3-phosphate, in particular for increasing the amount of glycerol and/or glycerol-3-phosphate in free or bound form in an organism or a part thereof, as mentioned. In one embodiment, in the process of the present invention the activity of a b2818 protein is increased or generated, e.g. from *Escherichia coli* or a homolog thereof, preferably linked at least to one transit peptide as mentioned for example in table V.

In another embodiment, in the process of the present invention the activity of a b2818 protein is increased or generated in a subcellular compartment of the organism or organism cell such as in an organelle like a plastid or mitochondria.

The sequence of b3429 (Accession number NP_417887) from *Escherichia coli* has been published in Blattner et al., Science 277 (5331), 1453-1474 (1997), and its activity is being defined as "glycogen synthase (starch synthase)". Accordingly, in one embodiment, the process of the present invention comprises the use of a "glycogen synthase (starch synthase)" or its homolog, e.g. as shown herein, for the production of the fine chemical, meaning of glycerol and/or glycerol-3-phosphate, in particular for increasing the amount of glycerol and/or glycerol-3-phosphate in free or bound form in an organism or a part thereof, as mentioned. In one embodiment, in the process of the present invention the activity of a b3429 protein is increased or generated, e.g. from *Escherichia coli* or a homolog thereof, preferably linked at least to one transit peptide as mentioned for example in table V.

In another embodiment, in the process of the present invention the activity of a b3429 protein is increased or generated in a subcellular compartment of the organism or organism cell such as in an organelle like a plastid or mitochondria.

The sequence of b3614 (Accession number S47835) from *Escherichia coli* has been published in Blattner et al., Science 277 (5331), 1453-1474 (1997), and its activity is being defined as "hypothetical 30.7K protein (secb-tdh intergenic region)". Accordingly, in one embodiment, the process of the present invention comprises the use of a "hypothetical 30.7K protein (secb-tdh intergenic region)" or its homolog, e.g. as shown herein, for the production of the fine chemical, meaning of glycerol and/or glycerol-3phosphate, in particular for increasing the amount of glycerol and/or glycerol-3phosphate in free or bound form in an organism or a part thereof, as mentioned. In one embodiment, in the process of the present invention the activity of a b3614 protein is increased or generated, e.g. from *Escherichia coli* or a homolog thereof, preferably linked at least to one transit peptide as mentioned for example in table V.

In another embodiment, in the process of the present invention the activity of a b3614 protein is increased or generated in a subcellular compartment of the organism or organism cell such as in an organelle like a plastid or mitochondria.

The sequence of b3708 (Accession number WZEC) from *Escherichia coli* has been published in Blattner et al., Science 277 (5331), 1453-1474 (1997), and its activity is being defined as "tryptophan deaminase, PLP-dependent". Accordingly, in one embodiment, the process of the present invention comprises the use of a "tryptophan deaminase, PLP-dependent" or its homolog, e.g. as shown herein, for the production of the fine chemical, meaning of glycerol and/or glycerol-3-phosphate, in particular for increasing the amount of glycerol and/or glycerol-3-phosphate in free or bound form in an organism or a part thereof, as mentioned. In one embodiment, in the process of the present invention the activity of a b3708 protein is increased or generated, e.g. from *Escherichia coli* or a homolog thereof, preferably linked at least to one transit peptide as mentioned for example in table V.

In another embodiment, in the process of the present invention the activity of a b3708 protein is increased or generated in a subcellular compartment of the organism or organism cell such as in an organelle like a plastid or mitochondria.

The sequence of b4055 (Accession number S54790) from *Escherichia coli* has been published in Blattner et al., Science 277 (5331), 1453-1474 (1997), and its activity is being defined as "acid phosphatase". Accordingly, in one embodiment, the process of the present invention comprises the use of a "acid phosphatase" or its homolog, e.g. as shown herein, for the production of the fine chemical, meaning of glycerol and/or glycerol-3-phosphate, in particular for increasing the amount of glycerol and/or glycerol-3phosphate in free or bound form in an organism or a part thereof, as mentioned. In one embodiment, in the process of the present invention the activity of a b4055 protein is increased or generated, e.g. from *Escherichia coli* or a homolog thereof, preferably linked at least to one transit peptide as mentioned for example in table V.

In another embodiment, in the process of the present invention the activity of a b4055 protein is increased or generated in a subcellular compartment of the organism or organism cell such as in an organelle like a plastid or mitochondria.

The sequence of YDR035W (Accession number NP_010320) from *Saccharomyces cerevisiae* has been published in Goffeau et al., Science 274 (5287), 546-547, 1996 and Jacq et al., Nature 387 (6632 Suppl), 75-78 (1997), and its activity is being defined as a "3-deoxy-D-arabino-heptulosonate-7-phosphate (DAHP) synthase". Accordingly, in one embodiment, the process of the present invention comprises the use of a "3deoxy-D-arabino-heptulosonate-7-phosphate synthase" or its homolog, e.g. as shown herein, for the production of the fine chemical, meaning of glycerol and/or glycerol-3phosphate, in particular for increasing the amount of glycerol and/or glycerol-3phosphate in free or bound form in an organism or a part thereof, as mentioned. In one embodiment, in the process of the present invention the activity of a YDR035W protein is increased or generated, e.g. from *Saccharomyces cerevisiae* or a homolog thereof, preferably linked at least to one transit peptide as mentioned for example in table V.

In another embodiment, in the process of the present invention the activity of an YDR035W protein is increased or generated in a subcellular compartment of the organism or organism cell such as in an organelle like a plastid or mitochondria.

In one embodiment, the homolog of the b0342, b1021, b2022, b2818, b3429, b3429, b3614, b3708 or b4055 is a homolog having said activity and being derived from bacteria. In one embodiment, the homolog of the b0342, b1021, b2022, b2818, b3429, b3429, b3614, b3708 or b4055 is a homolog having said activity and being derived from Proteobacteria. In one embodiment, the homolog of the b0342, b1021, b2022, b2818, b3429, b3429, b3614, b3708 or b4055 is a homolog having said activity and being derived from Gammaproteobacteria. In one embodiment, the homolog of the b0342, b1021, b2022, b2818, b3429, b3429, b3614, b3708 or b4055 is a homolog having said activity and being derived from Enterobacteriales. In one embodiment, the homolog of the b0342, b1021, b2022, b2818, b3429, b3429, b3614, b3708 or b4055 is a homolog having said activity and being derived from Enterobacteriaceae. In one embodiment, the homolog of the b0342, b1021, b2022, b2818, b3429, b3429, b3614, b3708 or b4055 is a homolog having said activity and being derived from *Escherichia*, preferably from *Escherichia coli*.

In one embodiment, the homolog of the YDR035W is a homolog having said activity and being derived from an eukaryotic. In one embodiment, the homolog of the YDR035W is a homolog having said activity and being derived from Fungi. In one embodiment, the homolog of the YDR035W is a homolog having said activity and being derived from Ascomyceta. In one embodiment, the homolog of the YDR035W is a homolog having said activity and being derived from *Saccharomycotina*. In one embodiment, the homolog of the YDR035W is a homolog having said activity and being derived from *Saccharomycetes*. In one embodiment, the homolog of the YDR035W is a homolog having said activity and being derived from *Saccharomycetales*. In one embodiment, the homolog of the YDR035W is a homolog having said activity and being derived from Saccharomycetaceae. In one embodiment, the homolog of the YDR035W is a homolog having said activity and being derived from *Saccharomycetes*.

for the disclosure of this paragraph see paragraph [0038.0.0.0] above.

In accordance with the invention, a protein or polypeptide has the "activity of an protein as shown in table II, application no. 22, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 22, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 22, column 3, or which has at least 10% of the original enzymatic activity, preferably 20%, particularly preferably 30%, most particularly preferably 40% in comparison to a protein as shown in table II, application no. 22, column 3 of *Saccharomyces cerevisiae*.

for the disclosure of the paragraphs [0040.0.0.21] to [0047.0.0.21] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 22, column 3 its biochemical or genetical causes and the increased amount of the fine chemical.

for the disclosure of the paragraphs [0049.0.0.21] to [0051.0.0.21] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 22, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modifiy the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.21] to [0058.0.0.21] see paragraphs [0053.0.0.0] to [0058.0.0.0] above.

In case the activity of the *Escherichia coli* protein b0342 or its homologs, e.g. a "thiogalactoside acetyltransferase" is increased advantageously in an organelle such as a plastid or mitochondria, preferably, in one embodiment an increase of the fine chemical, preferably of glycerol-3-phosphate in free or bound form, preferably in the lipid fraction, between 19% and 71% or more is conferred.

In case the activity of the *Escherichia coli* protein b1021 or its homologs, e.g. a "membrane protein ycdP" is increased advantageously in an organelle such as a plastid or mitochondria, preferably, in one embodiment an increase of the fine chemical, preferably of glycerol in free or bound form, preferably in the lipid fraction, between 47% and 89% or more is conferred.

In case the activity of the *Escherichia coli* protein b2022 or its homologs, e.g. a "bifunctional histidinol-phosphatase/imidazoleglycerol-phosphate dehydratase" is increased advantageously in an organelle such as a plastid or mitochondria, preferably, in one embodiment an increase of the fine chemical, preferably of glycerol in free or bound form, preferably in the lipid fraction, between 24% and 66% or more is conferred.

In case the activity of the *Escherichia coli* protein b2818 or its homologs, e.g. a "N-acetylglutamate synthase (amino acid N-acetyltransferase)" is increased advantageously in an organelle such as a plastid or mitochondria, preferably, in one embodiment an increase of the fine chemical, preferably of glycerol in free or bound form, preferably in the lipid fraction, between 17% and 29% or more is conferred.

In case the activity of the *Escherichia coli* protein b3429 or its homologs, e.g. a "glycogen synthase (starch synthase)" is increased advantageously in an organelle such as a plastid or mitochondria, preferably, in one embodiment an increase of the fine chemical, preferably of glycerol in free or bound form in the lipid fraction between 18% and 98% or more or glycerol in free or bound form in the polar fraction between 87% and 189% is conferred.

In case the activity of the *Escherichia coli* protein b3614 or its homologs, e.g. a "hypothetical 30.7K protein (secb-tdh intergenic region)" is increased advantageously in an organelle such as a plastid or mitochondria, preferably, in one embodiment an increase of the fine chemical, preferably of glycerol-3-phosphate in free or bound form, preferably in the lipid fraction, between 19% and 46% or more is conferred.

In case the activity of the *Escherichia coli* protein b3708 or its homologs, e.g. a "tryptophan deaminase, PLP-dependent" is increased advantageously in an organelle such as a plastid or mitochondria, preferably, in one embodiment an increase of the fine chemical, preferably of glycerol in free or bound form, preferably in the lipid fraction, between 19% and 39% or more is conferred.

In case the activity of the *Escherichia coli* protein b4055 or its homologs, e.g. a "acid phosphatase" is increased advantageously in an organelle such as a plastid or mitochondria, preferably, in one embodiment an increase of the fine chemical, preferably of glycerol in free or bound form, preferably in the lipid fraction, between 17% and 32% or more is conferred.

In case the activity of the *Saccaromyces cerevisiae* protein YDR035W or its homologs, e.g. a "3-deoxy-D-arabino-heptulosonate 7-phosphate (DAHP) synthase" is increased advantageously in an organelle such as a plastid or mitochondria, preferably, in one embodiment an increase of the fine chemical, preferably of glycerol in free or bound form, preferably in the lipid fraction, between 20% and 31% or more is conferred.

In case the activity of the *Escherichia coli* proteins b0342, b1021, b2022, b2818, b3429, b3429, b3614, b3708 and/or b4055 or their homologs, are increased advantageously in an organelle such as a plastid or mitochondria, preferably an increase of the fine chemical such as glycerol and/or glycerol-3-phosphate or mixtures thereof in free or bound form is conferred.

In case the activity of the *Saccaromyces cerevisiae* protein YDR035W or their homologs, are increased advantageously in an organelle such as a plastid or mitochondria, preferably an increase of the fine chemical such as glycerol and/or glycerol-3phosphate or mixtures thereof in free or bound form is conferred.

for the disclosure of the paragraphs [0061.0.0.21] and [0062.0.0.21] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 22, column 7 or of the polypeptide as shown in the amino acid sequences as disclosed in table II, application no. 22, columns 5 and 7 or the functional homologues thereof as described herein, or is encoded by the nucleic acid molecule characterized herein or the nucleic acid molecule according to the invention, for example by the nucleic acid molecule as shown in table I, application no. 22, columns 5 and 7 or its herein described functional homologues and has the herein mentioned activity.

/ for the disclosure of the paragraphs [0065.0.0.21] and [0066.0.0.21] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 22, columns 5 and 7 or its homologs activity having herein-mentioned glycerol and/or glycerol-3-phosphate increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 22, columns 5 and 7, e.g. a nucleic acid sequence encoding a polypeptide having the activity of a protein as indicated in table II, application no. 22, columns 5 and 7 or its homologs activity or of a mRNA encoding the polypeptide of the present invention having herein-mentioned glycerol and/or glycerol-3-phosphate increasing activity; and/or c) increasing the specific activity of a protein conferring the increased expression of a protein encoded by the nucleic acid molecule of the invention or of the polypeptide of the present invention having herein-mentioned glycerol and/or glycerol-3phosphate increasing activity, e.g. of a polypeptide having the activity of a protein as indicated in table II, application no. 22, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned glycerol and/or glycerol-3phosphate increasing activity, e.g. of a polypeptide having the activity of a protein as indicated in table II, application no. 22, columns 5 and 7 or its homologs activity; and/or e) stimulating activity of a protein conferring the increased expression of a protein encoded by the nucleic acid molecule of the present invention or a polypeptide of the present invention having herein-mentioned glycerol and/or glycerol-3phosphate increasing activity, e.g. of a polypeptide having the activity of a protein as indicated in table II, application no. 22, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned glycerol and/or glycerol-3-phosphate increasing activity, e.g. of a polypeptide having the activity of a protein as indicated in table II, application no. 22, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned glycerol and/or glycerol-3-phosphate increasing activity, e.g. of a polypeptide having the activity of a protein as indicated in table II, application no. 22, columns 5 and 7 or its homologs activity; and/or h) increasing the expression of the endogenous gene encoding the polypeptide of the invention, e.g. a polypeptide having the activity of a protein as indicated in table II, application no. 22, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, eg the elite crops; and/or k) directing a protein encoded by the nucleic acid molecule of the invention or of the polypeptide of the present invention having herein-mentioned glycerol and/or glycerol-3-phosphate increasing activity, e.g. of polypeptide having the activity of a protein as indicated in table II, application no. 22, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned glycerol and/or glycerol-3-phosphate increasing activity, e.g. of a polypeptide having the activity of a protein as indicated in table II, application no. 22, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned glycerol and/or glycerol-3-phosphate increasing activity, e.g. of a polypeptide having the activity of a protein as indicated in table II, application no. 22, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 22, column 3 or its homologs. Preferably the increase of the fine chemical takes place in plastids.

for the disclosure of the paragraphs [0069.0.0.21] to [0079.0.0.21] see paragraphs [0069.0.0.0] to [0079.0.0.0] above.

The activation of an endogenous polypeptide having above-mentioned activity, e.g. having the activity of a protein as shown in table II, application no. 22, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 22, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 22, column 3. The expression of the chimeric transcription factor in a organism, in particular in a plant, leads to a specific expression of the protein as shown in table II, application no. 22, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.21] to [0084.0.0.21] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. glycerol and/or glycerol-3phosphate and mixtures thereof.

for the disclosure of this paragraph see paragraph [0086.0.0.0] above.

By influencing the metabolism thus, it is possible to produce, in the process according to the invention, further advantageous compounds. Examples of such compounds are, in addition to glycerol and/or glycerol-3-phosphate compounds such as other polyols such as xylitol or sorbitol, fatty acid such as palmitic acid, oleic acid, linoleic acid, linolenic acid, vitamins, amino acids or carbohydrates.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II, application no. 22, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option it is also possible to produce, recover and, if desired isolate in addition, other free or/and bound polyols such as xylitol or sorbitol or lipids or mixtures thereof.

for the disclosure of the paragraphs [0090.0.0.21] to [0097.0.0.21] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I, application no. 22, columns 5 and 7 or a derivative thereof, or b) a genetic regulatory element, for example a promoter, which is functionally linked to the nucleic acid sequence as shown table I, application no. 22, columns 5 and 7 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 22, columns 5 and 7 joined to a nucleic acid sequence encoding a transit peptide, or a targeting nucleic acid sequence which directs the nucleic acid sequences disclosed in table I, application no. 22, columns 5 and 7 to the organelle preferentially the plastids. Alternatively the inventive nucleic acids sequences consist advantageously of the nucleic acid sequences as depicted in the sequence protocol and disclosed in table I, application no. 22, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose glycerol and/or glycerol-3-phosphate content is modified advantageously owing to the nucleic acid molecule of the present invention expressed. This is important for plant breeders since, for example, the nutritional value of plants for animals is dependent on the abovementioned glycerol and/or glycerol-3-phosphate and the general amount of glycerol and/or glycerol-3-phosphate in feed. After the activity of the protein as shown in table II, application no. 22, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.21] to [0110.0.0.21] see paragraphs [0102.0.0.0] to [0110.0.0.0] above.

In a preferred embodiment, the fine chemical (glycerol and/or glycerol-3-phosphate) is produced in accordance with the invention and, if desired, is isolated. The production of further polyols such as xylitol or sorbitol or lipids such as glycolipids, proteolipids, glycerolester and mixtures thereof or mixtures. It may be advantageous to increase the pool of free glycerol and/or glycerol-3-phosphate and other as aforementioned in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example another gene of the glycerol and/or glycerol-3-phosphate biosynthesis, or a compound, which functions as a sink for the desired glycerol and/or glycerol-3-phosphate in the organism is useful to increase the production of the respective fine chemical.

In a preferred embodiment, the respective fine chemical is produced in accordance with the invention and, if desired, is isolated. The production of further polyols other than glycerol and/or glycerol-3-phosphate or compounds for which the respective fine chemical is a biosynthesis precursor compounds, e.g. fatty acid ester, or mixtures thereof or mixtures of other polyols with the fine chemical, in particular of glycerol and/or glycerol-3-phosphate, by the process according to the invention is advantageous.

In the case of the fermentation of microorganisms, the abovementioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fine chemical such as glycerol and/or glycerol-3-phosphate synthesized in the process according to the invention can advantageously be marketed directly without there being any need for the fine chemical synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue. However, the respective fine chemical produced in the process according to the invention can also be isolated from the organisms, advantageously plants, (in the form of their organic extracts, e.g. alcohol, or other organic solvents or water containing extract and/or free glycerol and/or glycerol-3-phosphate or other extracts. The respective fine chemical produced by this process can be obtained by harvesting the organisms, either from the medium in which they grow, or from the field. This can be done via pressing or extraction of the plant parts. To increase the efficiency of extraction it is beneficial to clean, to temper and if necessary to hull and to flake the plant material. To allow for greater ease of disruption of the plant parts, specifically the seeds, they can previously be comminuted, steamed or roasted. Seeds, which have been pretreated in this manner can subsequently be pressed or extracted with solvents such as organic solvents like warm hexane or water or mixtures of organic solvents. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid. The fine chemical can than be isolated as free compound by for example alkaline or acid hydrolysis.

Because glycerol and/or glycerol-3-phosphate in microorganisms are localized intracellular, their recovery essentially comes down to the isolation of the biomass. Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose.

Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Glycerol and/or glycerol-3-phosphate can for example be analyzed advantageously via HPLC, LC or GC separation and MS (masspectrometry) detection methods. The unambiguous detection for the presence of glycerol and/or glycerol-3phosphate containing products can be obtained by analyzing recombinant organisms using analytical standard methods: GC; GC-MS, LC, LC-MS, MS or TLC). The material to be analyzed can be disrupted by sonication, grinding in a glass mill, liquid nitrogen and grinding, cooking, or via other applicable methods.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 22, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 22, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying nucleic acid molecules from a cDNA library or a genomic library using the primers shown in table III, application no. 22, column 7 and conferring an increase in the amount of the fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;
j) nucleic acid molecule which encodes a polypeptide comprising the consensus sequence shown in table IV, application no. 22, column 7 and conferring an increase in the amount of the fine chemical in an organism or a part thereof;
k) nucleic acid molecule comprising one or more of the nucleic acid molecule encoding the amino acid sequence of a polypeptide encoding a domain of the polypeptide shown in table II, application no. 22, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;
or which comprises a sequence which is complementary thereto.

In one embodiment, the nucleic acid molecule used in the process of the invention distinguishes over the sequence indicated in table IA, application no. 22, columns 5 and 7 by one or more nucleotides. In one embodiment, the nucleic acid molecule used in the process of the invention does not consist of the sequence indicated in table IA, application no. 22, columns 5 and 7. In one embodiment, the nucleic acid molecule used in the process of the invention is less than 100%, 99.999%, 99.99%, 99.9% or 99% identical to a sequence indicated in table IA, application no. 22, columns 5 and 7. In another embodiment, the nucleic acid molecule does not encode a polypeptide of a sequence indicated in table IIA, application no. 22, columns 5 and 7.

In one embodiment, the nucleic acid molecule used in the process of the invention distinguishes over the sequence indicated in table IB, application no. 22, columns 5 and 7, by one or more nucleotides. In one embodiment, the nucleic acid molecule used in the process of the invention does not consist of the sequence indicated in table IB, application no. 22, columns 5 and 7. In one embodiment, the nucleic acid molecule used in the process of the invention is less than 100%, 99.999%, 99.99%, 99.9% or 99% identical to a sequence indicated in table IB, application no. 22, columns 5 and 7. In another embodiment, the nucleic acid molecule does not encode a polypeptide of a sequence indicated in table IIB, application no. 22, columns 5 and 7.

In one embodiment, the nucleic acid molecule used in the process distinguishes over the sequence shown in table I, application no. 22, columns 5 and 7 by one or more nucleotides or does not consist of the sequence shown in table I, application no. 22, columns 5 and 7. In one embodiment, the nucleic acid molecule of the present invention is less than 100%, 99.999%, 99.99%, 99.9% or 99% identical to the sequence shown in table I, application no. 22, columns 5 and 7. In another embodiment, the nucleic acid molecule does not encode a polypeptide of the sequence shown in table II, application no. 22, columns 5 and 7.

for the disclosure of the paragraphs [0118.0.0.21] to [0120.0.0.21] see paragraphs [0118.0.0.0] to [0120.0.0.0] above.

Nucleic acid molecules with the sequence shown in table I, application no. 22, columns 5 and 7, nucleic acid molecules which are derived from the amino acid sequences shown in table II, application no. 22, columns 5 and 7 or from polypeptides comprising the consensus sequence shown in table IV, application no. 22, column 7, or their derivatives or homologues encoding polypeptides with the enzymatic or biological activity of a protein as shown in table II, application no. 22, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 22, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 22, column 3 and conferring the fine chemical increase by expression either in the cytsol or in an organelle such as a plastid or mitochondria or both, preferably in plastids.

for the disclosure of the paragraphs [0126.0.0.21] to [0133.0.0.21] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 22, columns 5 and 7 or the functional homologues thereof as described herein, preferably conferring above-mentioned activity, i.e. conferring the fine chemical increase after increasing its activity, e.g. after increasing the activity of a protein as shown in table II, application no. 22, column 3 by for example expression either in the cytsol or in an organelle such as a plastid or mitochondria or both, preferably in plastids.

for the disclosure of the paragraphs [0135.0.0.21] to [0140.0.0.21] see paragraphs [0135.0.0.0] to [0140.0.0.0] above.

Synthetic oligonucleotide primers for the amplification, e.g. as shown in table III, application no. 22, column 7, by means of polymerase chain reaction can be generated on the basis of a sequence shown herein, for example the sequence shown in table I, application no. 22, columns 5 and 7 or the sequences derived from table II, application no. 22, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 22, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 22, column 3 or further functional homologs of the polypeptide of the invention from other organisms.

for the disclosure of the paragraphs [0144.0.0.21] to [0151.0.0.21] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 22, columns 5 and 7, preferably of table IB, application no. 22, columns 5 and 7 under relaxed hybridization conditions and which code on expression for peptides having the glycerol and/or glycerol-3-phosphate increasing activity.

for the disclosure of the paragraphs [0153.0.0.21] to [0159.0.0.21] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 22, columns 5 and 7, preferably shown in table IB, application no. 22, columns 5 and 7 is one which is sufficiently complementary to one of the nucleotide sequences shown in table I, application no. 22, columns 5 and 7, preferably shown in table IB, application no. 22, columns 5 and 7 such that it can hybridize to one of the nucleotide sequences shown in table I, application no. 22, columns 5 and 7, preferably shown in table IB, application no. 22, columns 5 and 7, thereby forming a stable duplex. Preferably, the hybridisation is performed under stringent hybrization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 22, columns 5 and 7, preferably shown in table IB, application no. 22, columns 5 and 7, or a portion thereof and preferably has above mentioned activity, in particular having a fine chemical increasing activity after increasing the activity or an activity of a gene product as shown in table II, application no. 22, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 22, columns 5 and 7, preferably shown in table IB, application no. 22, columns 5 and 7, or a portion thereof and encodes a protein having above-mentioned activity, e.g. conferring of a glycerol and/or glycerol-3-phosphate increase by for example expression either in the cytsol or in an organelle such as a plastid or mitochondria or both, preferably in plastids, and optionally, the activity of a protein as shown in table II, application no. 22, column 3.

Moreover, the nucleic acid molecule of the invention can comprise only a portion of the coding region of one of the sequences shown in table I, application no. 22, columns 5 and 7, preferably shown in table IB, application no. 22, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 22, columns 5 and 7, an anti-sense sequence of one of the sequences, e.g., set forth in table I, application no. 22, columns 5 and 7, preferably shown in table IB, application no. 22, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 22, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 22, columns 5 and 7 such that the protein or portion thereof maintains the ability to participate in the fine chemical production, in particular a glycerol and/or glycerol-3-phosphate increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 22, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 22, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.21] and [0169.0.0.21] see paragraphs [0168.0.0.0] and [0169.0.0.0] above.

The invention further relates to nucleic acid molecules that differ from one of the nucleotide sequences shown in table I, application no. 22, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 22, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 22, columns 5 and 7 or the functional homologues. In a still further embodiment, the nucleic acid molecule of the invention encodes a full length protein which is substantially homologous to an amino acid sequence shown in table II, application no. 22, columns 5 and 7 or the functional homologues. However, in a preferred embodiment, the nucleic acid molecule of the present invention does not consist of the sequence shown in table I, application no. 22, columns 5 and 7, preferably as indicated in table IA, application no. 22, columns 5 and 7. Preferably the nucleic acid molecule of the invention is a functional homologue or identical to a nucleic acid molecule indicated in table IB, application no. 22, columns 5 and 7.

for the disclosure of the paragraphs [0171.0.0.21] to [0173.0.0.21] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 22, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 22, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 22, columns 5 and 7.

for the disclosure of the paragraphs [0179.0.0.21] and [0180.0.0.21] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 22, columns 5 and 7, preferably shown in table IIA, application no. 22, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 22, columns 5 and 7, preferably shown in table IIA, application no. 22, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 22, columns 5 and 7, preferably shown in table IIA, application no. 22, columns 5 and 7, more preferably at least about 70% identical to one of the sequences shown in table II, application no. 22, columns 5 and 7, preferably shown in table IIA, application no. 22, columns 5 and 7, even more preferably at least about 80%, 90%, 95% homologous to the sequence shown in table II, application no. 22, columns 5 and 7, preferably shown in table IIA, application no. 22, columns 5 and 7, and most preferably at least about 96%, 97%, 98%, or 99% identical to the sequence shown in table II, application no. 22, columns 5 and 7, preferably shown in table IIA, application no. 22, columns 5 and 7.

for the disclosure of the paragraphs [0182.0.0.21] to [0188.0.0.21] see paragraphs [0182.0.0.0] to [0188.0.0.0] above.

Functional equivalents derived from one of the polypeptides as shown in table II, application no. 22, columns 5 and 7, preferably shown in table IIB, application no. 22, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 22, columns 5 and 7, preferably shown in table IIB, application no. 22, columns 5 and 7 resp., according to the invention and are distinguished by essentially the same properties as the polypeptide as shown in table II, application no. 22, columns 5 and 7, preferably shown in table IIB, application no. 22, columns 5 and 7.

Functional equivalents derived from the nucleic acid sequence as shown in table I, application no. 22, columns 5 and 7, preferably shown in table IB, application no. 22, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 22, columns 5 and 7, preferably shown in table IIB, application no. 22, columns 5 and 7 resp., according to the invention and encode polypeptides having essentially the same properties as the polypeptide as shown in table II, application no. 22, columns 5 and 7, preferably shown in table IIB, application no. 22, columns 5 and 7.

for the disclosure of this paragraph see paragraph [0191.0.0.0] above.

A nucleic acid molecule encoding an homologous to a protein sequence of table II, application no. 22, columns 5 and 7, preferably shown in table IIB, application no. 22, columns 5 and 7 resp., can be created by introducing one or more nucleotide substitutions, additions or deletions into a nucleotide sequence of the nucleic acid molecule of the present invention, in particular of table I, application no. 22, columns 5 and 7, preferably shown in table IB, application no. 22, columns 5 and 7 resp., such that one or more amino acid substitutions, additions or deletions are introduced into the encoded protein. Mutations can be introduced into the encoding sequences of table I, application no. 22, columns 5 and 7, preferably shown in table IB, application no. 22, columns 5 and 7 resp., by standard techniques, such as site-directed mutagenesis and PCR-mediated mutagenesis.

for the disclosure of the paragraphs [0193.0.0.21] to [0196.0.0.21] see paragraphs [0193.0.0.0] to [0196.0.0.0] above.

Homologues of the nucleic acid sequences used, with the sequence shown in table I, application no. 22, columns 5 and 7, preferably shown in table IB, application no. 22, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 22, columns 5 and 7, preferably shown in table IB, application no. 22, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 22, columns 5 and 7, preferably shown in table IB, application no. 22, columns 5 and 7. It is preferred that the nucleic acid molecule comprises as little as possible other nucleotides not shown in any one of table I, application no. 22, columns 5 and 7, preferably shown in table IB, application no. 22, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 22, columns 5 and 7, preferably shown in table IB, application no. 22, columns 5 and 7.

Also preferred is that the nucleic acid molecule used in the process of the invention encodes a polypeptide comprising the sequence shown in table II, application no. 22, columns 5 and 7, preferably shown in table IIB, application no. 22, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 22, columns 5 and 7, preferably shown in table IIB, application no. 22, columns 5 and 7.

In one embodiment, the nucleic acid molecule of the invention or used in the process encodes a polypeptide comprising the sequence shown in table II, application no. 22, columns 5 and 7, preferably shown in table IIB, application no. 22, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 22, columns 5 and 7, preferably shown in table IB, application no. 22, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 22, columns 5 and 7 expressed under identical conditions.

Homologues of table I, application no. 22, columns 5 and 7 or of the derived sequences of table II, application no. 22, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.21] to [0215.0.0.21] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 22, columns 5 and 7, preferably in table IIB, application no. 22, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 22, columns 5 and 7, preferably in table IB, application no. 22, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table III, application no. 22, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 22, column 7 and conferring an increase in the amount of the fine chemical in an organism or a part thereof;

k) nucleic acid molecule encoding the amino acid sequence of a polypeptide encoding a domaine of the polypeptide shown in table II, application no. 22, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 22, columns 5 and 7 or a nucleic acid molecule encoding, preferably at least the mature form of, the polypeptide shown in table II, application no. 22, columns 5 and 7, and conferring an increase in the amount of the fine chemical in an organism or a part thereof; or which encompasses a sequence which is complementary thereto;

whereby, preferably, the nucleic acid molecule according to (a) to (l) distinguishes over the sequence depicted in table IA and/or IB, application no. 22, columns 5 and 7 by one or more nucleotides. In one embodiment, the nucleic acid molecule of the invention does not consist of the sequence shown in table IA and/or IB, application no. 22, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 22, columns 5 and 7. In a further embodiment the nucleic acid molecule does not encode the polypeptide sequence shown in table IIA and/or IIB, application no. 22, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 22, columns 5 and 7 does not encode a protein of the sequence shown in table IIA and/or IIB, application no. 22, columns 5 and 7. Accordingly, in one embodiment, the protein encoded by a sequence of a nucleic acid according to (a) to (l) does not consist of the sequence shown in table IA and/or IB, application no. 22, columns 5 and 7. In a further embodiment, the protein of the present invention is at least 30% identical to protein sequence depicted in table IIA and/or IIB, application no. 22, columns 5 and 7 and less than 100%, preferably less than 99.999%, 99.99% or 99.9%, more preferably less than 99%, 985, 97%, 96% or 95% identical to the sequence shown in table IIA and/or IIB, application no. 22, columns 5 and 7.

for the disclosure of the paragraphs [0217.0.0.21] to [0226.0.0.21] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 22, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.21] to [0239.0.0.21] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 22, columns 5 and 7 or its derivatives, it is advantageous additionally to express and/or mutate further genes in the organisms. Especially advantageously, additionally at least one further gene of the glycerol biosynthetic pathway is expressed in the organisms such as plants or microorganisms. Advantageously additional genes for the synthesis of glycerol and/or glycerol-3-phosphate are used. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 22, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the fatty acid metabolism, in particular in synthesis of glycerol and/or glycerol-3-phosphate. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the abovementioned biosynthesis genes are the sequences encoding further genes of the glycerol biosynthesis chain such as hexokinase, glucose-3-P-dehydrogenase, phosphofructokinase, aldolase, glycerol-3-P-dehydrogenase etc. It is also possible that the regulation of the natural genes has been modified advantageously so that the gene and/or its gene product is no longer subject to the regulatory mechanisms which exist in the organisms. This leads to an increased synthesis of glycerol and/or glycerol-3-phosphate precursors or glycerol and/or glycerol-3-phosphate, as desired since, for example, feedback regulations no longer exist to the same extent or not at all.

In a further advantageous embodiment of the process of the invention, the organisms used in the process are those in which advantageously simultaneously a glycerol and/or glycerol-3-phosphate degrading protein is attenuated, in particular by reducing the rate of expression of the corresponding gene, or by inactivating the gene for example the mutagenesis and/or selection. In another advantageous embodiment the synthesis of competitive pathways which rely on the same precoursers are down regulated or interrupted.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemical and other polyols produced by this process can be obtained by harvesting the organisms, either from the crop in which they grow, or from the field. This can be done via for example pressing or extraction of the plant parts.

Preferably, the compound is a composition comprising the essentially pure glycerol and/or glycerol-3-phosphate or a recovered or isolated glycerol and/or glycerol-3-phosphate.

for the disclosure of the paragraphs [0243.0.0.21] to [0264.0.0.21] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 22, columns 5 and 7 and described herein to achieve an expression in one of said compartments or extracellular.

for the disclosure of the paragraphs [0266.0.0.21] to [0287.0.0.21] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 22, columns 5 and 7 or their homologs is functionally linked to a plastidial targeting sequence. A further preferred embodiment of the invention relates to a vector in which a nucleic acid sequence encoding one of the polypeptides shown in table II, application no. 22, columns 5 and 7 or their homologs is functionally linked to a regulatory sequences which permit the expression in plastids.

for the disclosure of the paragraphs [0289.0.0.21] to [0296.0.0.21] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b0342, anti-b1021, anti-b2022, anti-b2818, anti-b3429, anti-b3429, anti-b3614, anti-b3708, anti-b4055 and/or anti-YDR035W protein antibody or an antibody against polypeptides as shown in table II, application no. 22, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 22, columns 5 and 7 or as coded by the nucleic acid molecule shown in table I, application no. 22, columns 5 and 7 or functional homologues thereof.

In one advantageous embodiment, in the method of the present invention the activity of a polypeptide is increased comprising or consisting of the consensus sequence shown in table IV, application no. 22, columns 7 and in one another embodiment, the present invention relates to a polypeptide comprising or consisting of the consensus sequence shown in table IV, application no. 22, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.21] to [0304.0.0.21] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 22, columns 5 and 7 by one or more amino acids. In one embodiment, polypeptide distinguishes form the sequence shown in table IIA and/or IIB, application no. 22, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 22, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 22, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 22, columns 5 and 7 by one or more amino acids. In another embodiment, said polypeptide of the invention does not consist of the sequence shown in table IIA and/or IIB, application no. 22, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 22, columns 5 and 7.

In one embodiment, the present invention relates to a polypeptide having the activity of the protein as shown in table IIA and/or IIB, application no. 22, column 3, which distinguishes over the sequence depicted in table IIA and/or IIB, application no. 22, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.21] to [0311.0.0.21] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 22, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 22, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 22, columns 5 and 7 or which is homologous thereto, as defined above.

Accordingly the polypeptide of the present invention can vary from the sequences shown in table IIA and/or IIB, application no. 22, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 22, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 22, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 22, column 3. Differences shall mean at least one amino acid different from the sequences as shown in table II, application no. 22, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 22, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 22, column 3. The nucleic acid molecules and polypeptide molecules of the invention are expressed such that the yield, production, and/or efficiency of production of a desired compound is improved.

for the disclosure of the paragraphs [0320.0.0.21] to [0322.0.0.21] see paragraphs [0320.0.0.0] to [0322.0.0.0] above.

In one embodiment, a protein (=polypeptide) as shown in table II, application no. 22, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 22, column 3, e.g., a protein which does not confer the activity described herein and which is derived from the same or a different organism.

for the disclosure of the paragraphs [0324.0.0.21] to [0329.0.0.21] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 22, columns 5 and 7.

for the disclosure of the paragraphs [0331.0.0.21] to [0346.0.0.21] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 22, column 3. Due to the above mentioned activity the fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 22, column 3 or a protein as shown in table II, application no. 22, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 22, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.21] to [0358.0.0.21] see paragraphs [0350.0.0.0] to [0358.0.0.0] above.

Transgenic plants comprising glycerol and/or glycerol-3-phosphate or mixtures thereof synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The glycerol and/or glycerol-3-phosphate produced in the process according to the invention may, however, also be isolated from the plant in the form of their free glycerol and/or glycerol-3-phosphate produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, cosmetics, pharmaceuticals or fine chemicals.

for the disclosure of the paragraphs [0360.0.0.21] to [0362.0.0.21] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the glycerol and/or glycerol-3-phosphate produced in the process can be isolated. The resulting fine chemical can, if appropriate, subsequently be further purified, if desired mixed with other active ingredients such as other xanthophylls, fatty acids, vitamins, amino acids, carbohydrates, antibiotics and the like, and, if appropriate, formulated.

In one embodiment, glycerol and/or glycerol-3-phosphate is the fine chemical.

The glycerol and/or glycerol-3-phosphate, in particular the respective fine chemicals obtained in the process are suitable as starting material for the synthesis of further products of value. For example, they can be used in combination with each other or alone for the production of pharmaceuticals, health products, foodstuffs, animal feeds, nutrients or cosmetics. Accordingly, the present invention relates a method for the production of pharmaceuticals, health products, food stuff, animal feeds, nutrients or cosmetics comprising the steps of the process according to the invention, including the isolation of the glycerol and/or glycerol-3-phosphate containing, in particular glycerol and/or glycerol-3-phosphate containing composition produced or the respective fine chemical produced if desired and formulating the product with a pharmaceutical acceptable carrier or formulating the product in a form acceptable for an application in agriculture. A further embodiment according to the invention is the use of the glycerol and/or glycerol-3-phosphate produced in the process or of the transgenic organisms in animal feeds, foodstuffs, medicines, food supplements, cosmetics or pharmaceuticals.

for the disclosure of the paragraphs [0366.0.0.21] to [0369.0.0.21] see paragraphs [0366.0.0.0] to [0369.0.0.0] above.

The fermentation broths obtained in this way, containing in particular glycerol and/or glycerol-3-phosphate in mixtures with other organic acids, amino acids, polypeptides or polysaccharides, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the glycerol and/or glycerol-3-phosphate, in particular the glycerol and/or glycerol-3-phosphate produced according to the invention further. For this purpose, the product-containing composition, e.g. a total or partial extraction fraction using organic solvents, is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.21] to [0376.0.0.21], [0376.1.0.21] and [0377.0.0.21] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 22, columns 5 and 7, preferably in table IB, application no. 22, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.21] to [0383.0.0.21] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 22, column 3, e.g. comparing near identical organisms with low and high activity of the proteins as shown in table II, application no. 22, column 3.

for the disclosure of the paragraphs [0385.0.0.21] to [0404.0.0.21] see paragraphs [0385.0.0.0] to [0404.0.0.0] above.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other polyols or lipids, in particular polyols such as zylitol or sorbitol.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorgansims, the plant, plant tissue, plant cell, or the part thereof of the invention, the vector of the invention, the agonist identified with the method of the invention, the antibody of the present invention, can be used for the reduction of the fine chemical in an organism or part thereof, e.g. in a cell.

for the disclosure of the paragraphs [0406.0.0.21] to [0435.0.0.21] see paragraphs [0406.0.0.0] to [0435.0.0.0] above.

Production of Glycerol and/or Glycerol-3-phosphate in *Chlamydomonas reinhardtii*

The glycerol and/or glycerol-3-phosphate production can be analysed as mentioned herein.

The proteins and nucleic acids can be analysed as mentioned below.

In addition a production in other organisms such as plants or microorganisms such as yeast, *Mortierella alpina, Corynebacterium glutamicum* or *Escherichia coli* is possible.

for the disclosure of the paragraphs [0437.0.0.21] and [0438.0.0.21] see paragraphs [0437.0.0.0] and [0438.0.0.0] above.

Example 9

Analysis of the Effect of the Nucleic Acid Molecule on the Production of Glycerol and/or Glycerol-3-phosphate The effect of the genetic modification of plants or algae on the production of a desired compound (such as glycerol and/or glycerol-3-phosphate) can be determined by growing the modified plant under suitable conditions (such as those described above) and analyzing the medium and/or the cellular components for the elevated production of desired product (i.e. of glycerol and/or glycerol-3-phosphate). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of and Determination of the Glycerol and/or Glycerol-3-phosphate Content:

Abbreviations: GC-MS, gas liquid chromatography/mass spectrometry; TLC, thin-layer chromatography.

The unambiguous detection for the presence of xanthophylls can be obtained by analyzing recombinant organisms using analytical standard methods: LC, LC-MSMS or TLC, as described The total glycerol and/or glycerol-3-phosphate produced in the organism for example in algae used in the inventive process can be analysed for example according to the following procedure:

The material such as algae or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, seperation of non-polar epiphase from more polar hypophasic derivatives and chromatography. E.g.:

For analysis, solvent delivery and aliquot removal can be accomplished with a robotic system comprising a single injector valve Gilson 232XL and a 402 2S1V diluter [Gilson, Inc. USA, 3000 W. Beltline Highway, Middleton, Wis.]. For saponification, 3 ml of 50% potassium hydroxide hydro-ethanolic solution (4 water:1 ethanol) can be added to each vial, followed by the addition of 3 ml of octanol. The saponification treatment can be conducted at room temperature with vials maintained on an IKA HS 501 horizontal shaker [Lab-world-online, Inc., Wilmington, N.C.] for fifteen hours at 250 movements/minute, followed by a stationary phase of approximately one hour.

Following saponification, the supernatant can be diluted with 0.10 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol:4 water:15 tetrahydrofuran (THF) stabilized with 0.2% BHT (2,6-di-tert-butyl-4-methylphenol). Injections were 20 µl. Separation can be isocratic at 30° C. with a flow rate of 1.7 ml/minute. The peak responses can be measured by absorbance at 447 nm.

If required and desired, further chromatography steps with a suitable resin may follow. Advantageously, the glycerol and/or glycerol-3-phosphate can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

for the disclosure of the paragraphs [0446.0.0.21] to [0496.0.0.21] see paragraphs [0446.0.0.0] to [0496.0.0.0] above.

Usually acetone or hexane is used for the extraction of the lipids and further purification is achieved either by column chromatography with a suitable resin.

If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

The results of the different plant analyses can be seen from the table, which follows:

TABLE VI

| ORF | Metabolite | Method | Min | Max |
|---|---|---|---|---|
| b0342 | Glycerol-3-phosphate, lipid fraction | GC | 1.19 | 1.71 |
| b1021 | Glycerol, polar fraction | GC | 1.47 | 1.89 |

TABLE VI-continued

| ORF | Metabolite | Method | Min | Max |
|---|---|---|---|---|
| b2022 | Glycerol, lipid fraction | GC | 1.24 | 1.66 |
| b2818 | Glycerol, lipid fraction | GC | 1.17 | 1.29 |
| b3429 | Glycerol, lipid fraction | GC | 1.18 | 1.98 |
| b3429 | Glycerol, polar fraction | GC | 1.87 | 2.89 |
| b3614 | Glycerol-3-phosphate, lipid fraction | GC | 1.19 | 1.46 |
| b3708 | Glycerol, lipid fraction | GC | 1.19 | 1.39 |
| b4055 | Glycerol, lipid fraction | GC | 1.17 | 1.32 |
| YDR035W | Glycerol, lipid fraction | GC | 1.20 | 1.31 | for the disclosure of the paragraphs [0499.0.0.21] and [0500.0.0.21] see paragraphs [0499.0.0.0] and [0500.0.0.0] above.

Example 15a

Engineering Ryegrass Plants by Over-Expressing b0342 from *Escherichia coli* or Homologs of b0342 from Other Organisms for the disclosure of the paragraphs [0502.0.0.21] to [0508.0.0.21] see paragraphs [0502.0.0.0] to [0508.0.0.0] above.

Example 15b

Engineering Soybean Plants by Over-expressing b0342 from *Escherichia coli* or Homologs of b0342 from Other Organisms for the disclosure of the paragraphs [0510.0.0.21] to [0513.0.0.21] see paragraphs [0510.0.0.0] to [0513.0.0.0] above.

Example 15c

Engineering Corn Plants by Over-expressing b0342 from *Escherichia coli* or Homologs of b0342 from Other Organisms for the disclosure of the paragraphs [0515.0.0.21] to [0540.0.0.21] see paragraphs [0515.0.0.0] to [0540.0.0.0] above.

Example 15d

Engineering Wheat Plants by Over-expressing b0342 from *Escherichia coli* or Homologs of b0342 from Other Organisms for the disclosure of the paragraphs [0542.0.0.21] to [0544.0.0.21] see paragraphs [0542.0.0.0] to [0544.0.0.0] above.

Example 15e

Engineering Rapeseed/Canola Plants by Over-Expressing b0342 from *Escherichia coli* or Homologs of b0342 from Other Organisms for the disclosure of the paragraphs [0546.0.0.21] to [0549.0.0.21] see paragraphs [0544.0.0.0] to [0549.0.0.0] above.

Example 15f

Engineering Alfalfa Plants by Over-Expressing b0342 from *Escherichia coli* or Homologs of b0342 from Other Organisms for the disclosure of the paragraphs [0551.0.0.21] to [0554.0.0.21] see paragraphs [0551.0.0.0] to [0554.0.0.0] above.

% for the disclosure of this paragraph see [0554.2.0.0] above.
for the disclosure of this paragraph see [0555.0.0.0] above.
for the disclosure of this paragraph see [0001.0.0.0].

Lipids differ markedly from other groups of biomolecules and metabolites. By definition, lipids are water-insoluble biomolecules that are highly soluble in organic solvents such as chloroform. Lipids have a variety of biological roles: they serve as fuel molecules, highly concentrated energy stores, signal molecules, and components of membranes.

The major kinds of membrane lipids are phospholipids, glycolipids, and cholesterol. Glycolipids are sugar-containing lipids. The term glycolipid designates any compound containing one or more monosaccharide residues bound by a glycosidic linkage to a hydrophobic moiety such as an acylglycerol, a sphingoid, a ceramide (N-acylsphingoid) or a prenyl phosphate.

Galactose-containing lipids are the predominant nonproteinaceous components of photosynthetic membranes in plants, algae, and a variety of bacteria. In higher plants, the galactolipids contain a high proportion of polyunsaturated fatty acids, up to 95% of which can be linolenic acid (18:3(n-3)). In non-photosynthetic tissues, such as tubers or roots, the $C_{18}$ fatty acids are usually more saturated.

In plants, especially photosynthetic tissues, a substantial proportion of the lipids consists of 1,2-diacyl-sn-glycerols joined by a glycosidic linkage at position sn-3 to a carbohydrate moiety. The two most common galactolipids are monogalactosyl diacylglycerol and digalactosyl diacylglycerol. Up to 80% of all lipids in plants are associated with photosynthetic membranes, and monogalactosyl diacylglycerol is widely considered to be the most abundant membrane lipid on earth.

Monogalactosyldiacylglycerols are not solely plant lipids as they have been found in small amounts in brain and nervous tissue in some animal species.

Related compounds of those main components of plant glycolipids, e.g. mono- and digalactosyldiacylglycerols, have been found with up to four galactose units, or in which one or more of these is replaced by glucose moieties. In addition, a 6-O-acyl-monogalactosyldiacylglycerol is occasionally a component of plant tissues.

The final step in monogalactosyl diacylglycerol biosynthesis occurs in the plastid envelope and is catalyzed by monogalactosyl diacylglycerol synthase (EC 2.4.1.46). This enzyme transfers D-galactose from UDP-galactose to sn-1,2-diacylglycerol (DAG) (Joyard, J. & Douce, R. Stumpf, P. K., ed. (1987) in Biochemistry of Plants (Academic, New York).

Digalactosyl diacylglycerol synthase catalyzes the transfer of galactose from one molecule of monogalactosyl diacylglycerol to another, producing digalactosyl diacylglycerol and DAG in equimolar amounts.

Even if some details are known, galactolipid biosynthesis in plants is highly complex. It involves multiple pathways giving rise to different molecular species.

Recent studies indicate that the amounts of the lipids sulfolipid sulfoquinovosyldiacylglycerol (SQDG) and digalactosyldiacylglycerol and DGDG increase strongly during phosphate deprivation (Härtel et al., Proc. Natl. Acad. Sci., 97, 10649-10654, 2000). When phosphate is limiting, phospholipids in plant membranes are reduced and at least in part replaced by glycolipids (i.e., SQDG and DGDG).

In addition to serving as a surrogate lipid for phospholipids, galactolipids were found to be critical for the stabilization of photosynthetic complexes in the thylakoids (Dörmann and Benning, Trends Plant Sci. 7, 112-118, 2002).

In contrast to plants, which contain high amounts of glycolipids, which carry a sugar moiety in the head group, in animals and yeast phospholipids are very abundant. Nevertheless, one type of glycolipids to be found in mammalians are galactosylceramide (cerebroside), which is prevalent in brain and the central nervous system. The cerebrosides have been localized to the outer leaflet of the plasma membrane, exposed on the cell surface. They seem to be responsible for the different blood types. Blood group antigens include cerebrosides with multiple sugars attached.

It has long been recognized that many complex glycolipid antigens are involved in the binding of lectins and antibodies at the cell surface glycolipids, containing only a single sugar headgroup, may play a combination of immunological, regulatory and structural roles in the membrane (Varki et al., Essentials of Glycobiology. Cold Spring Harbor Laboratory Press, New York, 1999).

The glycosphingolipid, galactosylceramide, has been shown to be a key activator of triggered cell death (Zhao et al., Cancer Res. 59, 482-486, 1999) and may play a role in the inhibition of virus replication (Kakimi et al., J. Exp. Med. 192, 921-930, 2000). It has recently been demonstrated that galactolipids are also responsible for preventing cell damage and the high resistance to oxidation and heat in the membranes of some microorganisms (Nakata, J. Biochem. 127, 731-737, 2000).

Other glycoglycerolipids, such as the 1,2-di-Oacyl-3-O-(D-galactopyranosyl)-sn-glycerols, are found widely in nature as structural components of the photosynthetic membranes of higher plants in the cell membranes of prokaryotic blue-green algae and several other microorganisms and in the seeds of cereals, such as wheat and oats.

Galactolipids are one of the more abundant lipid classes in nature. Sources for the galactolipids are foodstuffs, such as certain grains (oat, wheat, barley, and maize), which have been a significant part of the human diet since the beginning of time.

In addition galactolipids contain important fatty acids like linoleic acid, linolenic acids and others which have numerous applications in the food and feed industry, in cosmetics and in the drug sector. For example for cyanobacterium and marine green algae fermentation it has been described that the gamma-linolenic acid (GLA) was restricted the galactolipid fraction (Cohen et al., J. Appl. Phycol.; (1993) 5, 1, 109-15; FEMS-Microbiol. Lett.; (1993) 107, 2-3, 163-67), meaning that increasing the concentration of galactolipids can be another method for increasing the concentration of interesting fatty acids like linoleic acid, linolenic acid, stearic acid and palmitic acid in some production systems.

Most vegetables and fruits in human and animal diets contain galactolipids, and their breakdown products represent an important dietary source of galactose and polyunsaturated fatty acids.

On account of the positive properties and interesting physiological roles potential of galactose and galactose comprising lipids there is a need to produce those compounds in large amounts and well defined quality and composition.

Thus, it would be desirable to produce galactolipids, in a defined proportion in microorganisms or plants. This should be in way, which is not dependent on the availability of phosphate, in particular on phosphate deprivation. One way to increase the productive capacity of biosynthesis is to apply recombinant DNA technology. That type of production permits control over quality, quantity and selection of the most suitable and efficient producer organisms. The latter is especially important for commercial production economics and therefore availability to consumers.

Accordingly, there is still a great demand for new and more suitable genes which encode enzymes or other regulators which participate in the biosynthesis of said galactolipids and make it possible to produce said galactolipids specifically on an industrial scale without that unwanted byproducts are formed. In the selection of genes for biosynthesis two characteristics above all are particularly important. On the one hand, there is as ever a need for improved processes for obtaining the highest possible contents of said galactolipids on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is is a lipid, preferably a glycolipid containing galactose, glucose, mannose, rhamnose or xylose, more preferably a galactolipid containing galactose or glucose, most preferably a galactolipid containing galactose. Accordingly, in the present invention, the term "the fine chemical" as used herein relates to "lipid, preferably a glycolipid containing galactose, glucose, mannose, rhamnose or xylose, more preferably a galactolipid containing galactose or glucose, most preferably a galactolipid containing galactose in free or bound form". Further, the term "the fine chemicals" as used herein also relates to fine chemicals comprising lipid, preferably a glycolipid, a glycolipid containing galactose, glucose, mannose, rhamnose or xylose, more preferably a galactolipid containing galactose or glucose, most preferably a galactolipid containing galactose.

In one embodiment, the term "lipid, preferably a glycolipid, a glycolipid containing galactose, glucose, mannose, rhamnose or xylose, more preferably a galactolipid containing galactose or glucose, most preferably a galactolipid containing galactose in free or bound form", "the fine chemical" or "the respective fine chemical" means at least one chemical compound selected from the group consisting of glycolipids containing galactose, glucose, mannose, rhamnose or xylose, more preferably a galactolipid containing galactose or glucose, most preferably a galactolipid containing galactose. Throughout the specification the term "the fine chemical" or "the respective fine chemical" means a compound selected from the group of glycolipids containing galactose, glucose, mannose, rhamnose or xylose, more preferably a galactolipid containing galactose or glucose, most preferably a galactolipid containing galactose or mixtures thereof in free form or bound to other compounds.

In one embodiment, the term "the fine chemical" and the term "the respective fine chemical" mean at least one chemical compound with an activity of the abovementioned fine chemical.

In one embodiment, the term "the fine chemical" and the term "the respective fine chemical" mean at least one chemical compound with an activity of the above mentioned fine chemical Accordingly, the present invention relates to a process for the production of glycolipids containing galactose, glucose, mannose, rhamnose or xylose, more preferably a galactolipid containing galactose or glucose, most preferably a galactolipid containing galactose, which comprises (a) increasing or generating the activity of a protein as shown in table II, application no. 23, column 3 encoded by the nucleic acid sequences as shown in table I, application no. 23, column 5, in an organelle of a microorganism or plant, or
(b) increasing or generating the activity of a protein as shown in table II, application no. 23, column 3 encoded by the nucleic acid sequences as shown in table I, application no. 23, column 5 in the plastid of a microorganism or plant, or in one or more parts thereof; and
(c) growing the organism under conditions which permit the production of the fine chemical, thus, glycolipids containing galactose, glucose, mannose, rhamnose or xylose, more preferably a galactolipid containing galactose or glucose, most preferably a galactolipid containing galactose or fine chemicals comprising glycolipids containing galactose, glucose, mannose, rhamnose or xylose, more preferably a galactolipid containing galactose or glucose, most preferably a galactolipid containing galactose, are produced in said organism or in the culture medium surrounding the organism.

Accordingly, the term "the fine chemical" means "a lipid, preferably a glycolipid, a glycolipid containing galactose, glucose, mannose, rhamnose or xylose, more preferably a galactolipid containing galactose or glucose" in relation to all sequences listed in table I, application no. 23, columns 5 and 7 or homologs thereof. Accordingly, the term "a lipid, preferably a glycolipide, a glycolipid containing galactose, more preferably a galactolipid or cerebroside", owing to circumstances and the context. Preferably the term "the fine chemical" means preferably a "glycolipide containing galactose or glucose, more preferably a galactolipide". In order to illustrate that the meaning of the term "the respective fine chemical" means a "lipid, preferably a glycolipide, a glycolipid containing galactose, more preferably a galactolipide in free or bound form" owing to the sequences listed in the context the term "the respective fine chemical" is also used.

Whereas glycolipids are any lipid containing one or more monosaccharide residues bound by a glycosidic linkage to a hydrophobic moiety such as an acylglycerol, a sphingoid, a ceramide (N-acylsphingoid) or a prenyl phosphate. The term "glycosphingolipid" in the sense of the invention means lipids containing at least one monosaccharide residue and either a sphingoid or a ceramide.

In another embodiment the present invention is related to a process for the production of glycolipids containing galactose, glucose, mannose, rhamnose or xylose, more preferably a galactolipid containing galactose or glucose, most preferably a galactolipid containing galactose, which comprises
(a) increasing or generating the activity of a protein as shown in table II, application no. 23, column 3 encoded by the nucleic acid sequences as shown in table I, application no. 23, column 5, in an organelle of a non-human organism, or
(b) increasing or generating the activity of a protein as shown in table II, application no. 23, column 3 encoded by the nucleic acid sequences as shown in table I, application no. 23, column 5, which are joined to a nucleic acid sequence encoding a transit peptide in a non-human organism, or in one or more parts thereof; or
(c) increasing or generating the activity of a protein as shown in table II, application no. 23, column 3 encoded by the nucleic acid sequences as shown in table I, application no. 23, column 5, which are joined to a nucleic acid sequence encoding chloroplast localization sequence, in a non-human organism, or in one or more parts thereof, and
(d) growing the organism under conditions which permit the production of glycolipids containing galactose, glucose, mannose, rhamnose or xylose, more preferably a galactolipid containing galactose or glucose, most preferably a galactolipid containing galactose in said organism.

In another embodiment, the present invention relates to a process for the production of glycolipids containing galactose, glucose, mannose, rhamnose or xylose, more preferably a galactolipid containing galactose or glucose, most preferably a galactolipid containing galactose, which comprises
(a) increasing or generating the activity of a protein as shown in table II, application no. 23, column 3 encoded by the nucleic acid sequences as shown in table I, application no. 23, column 5, in an organelle of a microorganism or plant through the transformation of the organelle, or
(b) increasing or generating the activity of a protein as shown in table II, application no. 23, column 3 encoded by the nucleic acid sequences as shown in table I, application no. 23, column 5 in the plastid of a microorganism or plant, or in one or more parts thereof through the transformation of the plastids; and
(c) growing the organism under conditions which permit the production of the fine chemical, thus, glycolipids containing galactose, glucose, mannose, rhamnose or xylose, more preferably a galactolipid containing galactose or glucose, most preferably a galactolipid containing galactose or fine chemicals comprising glycolipids containing galactose, glucose, mannose, rhamnose or xylose, more preferably a galactolipid containing galactose or glucose, most preferably a galactolipid containing galactose in said organism or in the culture medium surrounding the organism.

Advantageously the activity of the protein as shown in table II, application no. 23, column 3 encoded by the nucleic acid sequences as shown in table I, application no. 23, column 5 is increased or generated in the abovementioned process in the plastid of a microorganism or plant.

for the disclosure of the paragraphs [0019.0.0.22] to [0024.0.0.22] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 23, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 23, column 3 and its homologs as disclosed in table I, application no. 23, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 23, column 3 and its homologs as disclosed in table I, application no. 23, columns 5 and 7.

for the disclosure of the paragraphs [0027.0.0.22] to [0029.0.0.22] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 23, columns 5 and 7. The person skilled in the art is able to join said sequences in a functional manner. Advantageously the transit peptide part is cleaved off from the protein part shown in table II, application no. 23, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 23, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 23, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 23, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 23, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 23, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.22] and [0030.3.0.22] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 23, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 23, columns 5 and 7 or a sequence encoding a protein, as depicted in table II, application no. 23, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I, application no. 23, columns 5 and 7 or a sequence encoding a protein, as depicted in table II, application no. 23, columns 5 and 7 in such a manner that the viroid sequence transports a sequence transcribed from a sequence as depicted in table I, application no. 23, columns 5 and 7 or a sequence encoding a protein as depicted in table II, application no. 23, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 23, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 23, columns 5 and 7.

In a preferred embodiment of the invention the nucleic acid sequences as shown in table I, application no. 23, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 23, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.22] and [0032.0.0.22] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 23, column 3. Preferably the modification of the activity of a protein as shown in table II, application no. 23, column 3 or their combination can be achieved by joining the protein to a transit peptide.

Surprisingly it was found, that the transgenic expression of the *Saccaromyces cerevisiae* protein as shown in table II, application no. 23, column 3 in plastids of a plant such as *Arabidopsis thaliana* for example through the linkage to at least one targeting sequence for example as mentioned in table V conferred an increase in the fine chemical content of the transformed plants.

for the disclosure of this paragraph see paragraph [0035.0.0.0] above.

The sequence of b3708 (Accession number WZEC) from *Escherichia coli* has been published in Blattner et al., Science 277 (5331), 1453-1474 (1997), and its activity is being defined as "tryptophan deaminase, PLP-dependent". Accordingly, in one embodiment, the process of the present invention comprises the use of a "tryptophan deaminase, PLP-dependent" or its homolog, e.g. as shown herein, for the production of the fine chemical, meaning of galactolipids, in particular for increasing the amount of galactolipids in free or bound form in an organism or a part thereof, as mentioned. In one embodiment, in the process of the present invention the activity of a b3708 protein is increased or generated, e.g. from *Escherichia coli* or a homolog thereof, preferably linked at least to one transit peptide as mentioned for example in table V.

In another embodiment, in the process of the present invention the activity of a b3708 protein is increased or generated in a subcellular compartment of the organism or organism cell such as in an organelle like a plastid or mitochondria.

In one embodiment, the homolog of the b3708 is a homolog having said activity and being derived from bacteria. In one embodiment, the homolog of the b3708 is a homolog having said activity and being derived from Proteobacteria. In one embodiment, the homolog of the b3708 is a homolog having said activity and being derived from Gammaproteobacteria. In one embodiment, the homolog of the b3708 is a homolog having said activity and being derived from Enterobacteriales. In one embodiment, the homolog of the b3708 is a homolog having said activity and being derived from Enterobacteriaceae. In one embodiment, the homolog of the b3708 is a homolog having said activity and being derived from *Escherichia*, preferably from *Escherichia coli*.

for the disclosure of this paragraph see paragraph [0038.0.0.0] above.

In accordance with the invention, a protein or polypeptide has the "activity of an protein as shown in table II, application no. 23, column 3" if its de novo activity, or its increased expression directly or indirectly leads to an increased in the fine chemical level in the organism or a part thereof, preferably in a cell of said organism, more preferably in an organelle such as a plastid or mitochondria of said organism and the protein has the above mentioned activities of a protein as shown in table II, application no. 23, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 23, column 3, or which has at least 10% of the original enzymatic activity, preferably 20%, particularly preferably 30%, most particularly preferably 40% in comparison to a protein as shown in table II, application no. 23, column 3 of *Saccharomyces cerevisiae*.

for the disclosure of the paragraphs [0040.0.0.22] to [0047.0.0.22] see paragraphs [0040.0.0.0] to [0047.0.0.0] above.

Preferably, the reference, control or wild type differs form the subject of the present invention only in the cellular activity, preferably of the plastidial acitvity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II, application no. 23, column 3 its biochemical or genetical causes and the increased amount of the fine chemical.

for the disclosure of the paragraphs [0049.0.0.22] to [0051.0.0.22] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 23, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.22] to [0058.0.0.22] see paragraphs [0053.0.0.0] to [0058.0.0.0] above.

In case the activity of the *Escherichia coli* protein b3708 or its homologs, e.g. a "tryptophan deaminase, PLP-dependent" is increased advantageously in an organelle such as a plastid or mitochondria, preferably, in one embodiment an increase of the fine chemical, preferably of galactolipids in free or bound form between 14% and 34% or more is conferred.

In case the activity of the *Escherichia coli* proteins b3708 or their homologs, are increased advantageously in an organelle such as a plastid or mitochondria, preferably an increase of the fine chemical such as glycolipids containing galactose or glucose or mixtures thereof in free or bound form is conferred.

for the disclosure of the paragraphs [0061.0.0.22] and [0062.0.0.22] see paragraphs [0061.0.0.0] and [0062.0.0.0] above.

A protein having an activity conferring an increase in the amount or level of the fine chemical, preferably upon targeting to the plastids preferably has the structure of the polypeptide described herein, in particular of the polypeptides comprising the consensus sequence shown in table IV, application no. 23, column 7 or of the polypeptide as shown in the amino acid sequences as disclosed in table II, application no. 23, columns 5 and 7 or the functional homologues thereof as described herein, or is encoded by the nucleic acid molecule characterized herein or the nucleic acid molecule according to the invention, for example by the nucleic acid molecule as shown in table I, application no. 23, columns 5 and 7 or its herein described functional homologues and has the herein mentioned activity.

/ for the disclosure of the paragraphs [0065.0.0.22] and [0066.0.0.22] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 23, columns 5 and 7 or its homologs activity having herein-mentioned glycolipids containing galactose, glucose, mannose, rhamnose or xylose, more preferably a galactolipid containing galactose or glucose, most preferably a galactolipid containing galactose increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 23, columns 5 and 7, e.g. a nucleic acid sequence encoding a polypeptide having the activity of a protein as indicated in table II, application no. 23, columns 5 and 7 or its homologs activity or of a mRNA encoding the polypeptide of the present invention having herein-mentioned glycolipids containing galactose, glucose, mannose, rhamnose or xylose, more preferably a galactolipid containing galactose or glucose, most preferably a galactolipid containing galactose increasing activity; and/or c) increasing the specific activity of a protein conferring the increased expression of a protein encoded by the nucleic acid molecule of the invention or of the polypeptide of the present invention having herein-mentioned glycolipids containing galactose, glucose, mannose, rhamnose or xylose, more preferably a galactolipid containing galactose or glucose, most preferably a galactolipid containing galactose increasing activity, e.g. of a polypeptide having the activity of a protein as indicated in table II, application no. 23, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned glycolipids containing galactose, glucose, mannose, rhamnose or xylose, more preferably a galactolipid containing galactose or glucose, most preferably a galactolipid containing galactose increasing activity, e.g. of a polypeptide having the activity of a protein as indicated in table II, application no. 23, columns 5 and 7 or its homologs activity; and/or e) stimulating activity of a protein conferring the increased expression of a protein encoded by the nucleic acid molecule of the present invention or a polypeptide of the present invention having herein-mentioned glycolipids containing galactose, glucose, mannose, rhamnose or xylose, more preferably a galactolipid containing galactose or glucose, most preferably a galactolipid containing galactose increasing activity, e.g. of a polypeptide having the activity of a protein as indicated in table II, application no. 23, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned glycolipids containing galactose, glucose, mannose, rhamnose or xylose, more preferably a galactolipid containing galactose or glucose, most preferably a galactolipid containing galactose increasing activity, e.g. of a polypeptide having the activity of a protein as indicated in table II, application no. 23, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned glycolipids containing galactose, glucose, mannose, rhamnose or xylose, more preferably a galactolipid containing galactose or glucose, most preferably a galactolipid containing galactose increasing activity, e.g. of a polypeptide having the activity of a protein as indicated in table II, application no. 23, columns 5 and 7 or its homologs activity; and/or h) increasing the expression of the endogenous gene encoding the polypeptide of the invention, e.g. a polypeptide having the activity of a protein as indicated in table II, application no. 23, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned glycolipids containing galactose, glucose, mannose, rhamnose or xylose, more preferably a galactolipid containing galactose or glucose, most preferably a galactolipid containing galactose increasing activity, e.g. of polypeptide having the activity of a protein as indicated in table II, application no. 23, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned glycolipids containing galactose, glucose, mannose, rhamnose or xylose, more preferably a galactolipid containing galactose or glucose, most preferably a galactolipid containing galactose increasing activity, e.g. of a polypeptide having the activity of a protein as indicated in table II, application no. 23, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned glycolipids containing galactose, glucose, mannose, rhamnose or xylose, more preferably a galactolipid containing galactose or glucose, most preferably a galactolipid containing galactose increasing activity, e.g. of a polypeptide having the activity of a protein as indicated in table II, application no. 23, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the fine chemical after increasing the expression or activity of the encoded polypeptide preferably in organelles such as plastids or having the activity of a polypeptide having an activity as the protein as shown in table II, application no. 23, column 3 or its homologs. Preferably the increase of the fine chemical takes place in plastids.

for the disclosure of the paragraphs [0069.0.0.22] to [0079.0.0.22] see paragraphs [0069.0.0.0] to [0079.0.0.0] above.

The activation of an endogenous polypeptide having above-mentioned activity, e.g. having the activity of a protein as shown in table II, application no. 23, column 3 or of the polypeptide of the invention, e.g. conferring the increase of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 23, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 23, column 3. The expression of the chimeric transcription factor in a organism, in particular in a plant, leads to a specific expression of the protein as shown in table II, application no. 23, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.22] to [0084.0.0.22] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. glycolipids containing galactose, glucose, mannose, rhamnose or xylose, more preferably a galactolipid containing galactose or glucose, most preferably a galactolipid containing galactose and mixtures thereof.

for the disclosure of this paragraph see paragraph [0086.0.0.0] above.

By influencing the metabolism thus, it is possible to produce, in the process according to the invention, further advantageous compounds. Examples of such compounds are, in addition to glycolipids containing galactose, glucose, mannose, rhamnose or xylose, more preferably a galactolipid containing galactose or glucose, most preferably a galactolipid containing galactose compounds such as other glycolipids such as glycosphingolipids, sulfoglycosphingolipids, phosphoglycosphingolipids, glycophosphatidyl inositol, vitamins, amino acids or fatty acids.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 23, column 3 or of a polypeptide being encoded by the nucleic acid molecule of the present invention and described below, e.g. conferring an increase of the fine chemical in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
d) if desired, recovering, optionally isolating, the free and/or bound fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the fine chemical or the free and bound the fine chemical but as option is also possible to produce, recover and, if desired isolate, other free or/and bound glycolipids such as glycosphingolipids, sulfoglycosphingolipids, phosphoglycosphingolipids, glycophosphatidyl inositol or mixtures thereof.

The fermentation broth, fermentation products, plants or plant products can be purified in the customary manner by hydrolysis with strong bases, extraction and crystallization or via thin layer chromatography and other methods known to the person skilled in the art and described herein below. Products of these different work-up procedures are fatty acids or fatty acid compositions which still comprise fermentation broth, plant particles and cell components in different amounts, advantageously in the range of from 0 to 99% by weight, preferably below 80% by weight, especially preferably between below 50% by weight.

for the disclosure of the paragraphs [0090.0.0.22] to [0097.0.0.22] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 23, columns 5 and 7 or a derivative thereof, or
b) a genetic regulatory element, for example a promoter, which is functionally linked to the nucleic acid sequence as shown table I, application no. 23, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 23, columns 5 and 7 joined to a nucleic acid sequence encoding a transit peptide, or a targeting nucleic acid sequence which directs the nucleic acid sequences disclosed in table I, application no. 23, columns 5 and 7 to the organelle preferentially the plastids. Alternatively the inventive nucleic acids sequences consist advantageously of the nucleic acid sequences as depicted in the sequence protocol and disclosed in table I, application no. 23, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose glycolipid content is modified advantageously owing to the nucleic acid molecule of the present invention expressed. This is important for plant breeders since, for example, the nutritional value of plants for animals is dependent on the abovementioned glycolipids containing galactose, glucose, mannose, rhamnose or xylose, more preferably a galactolipid containing galactose or glucose, most preferably a galactolipid containing galactose and the general amount of glycolipids containing galactose, glucose, mannose, rhamnose or xylose, more preferably a galactolipid containing galactose or glucose, most preferably a galactolipid containing galactose in feed. After the activity of the protein as shown in table II, application no. 23, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.22] to [0110.0.0.22] see paragraphs [0102.0.0.0] to [0110.0.0.0] above.

In a preferred embodiment, the fine chemical (glycolipid) is produced in accordance with the invention and, if desired, is isolated. The production of further glycolipids such as glycosphingolipids, sulfoglycosphingolipids, phosphoglycosphingolipids, glycophosphatidyl inositol or mixtures thereof or mixtures of other glycolipids by the process according to the invention is advantageous. It may be advantageous to increase the pool of free glycolipids containing galactose, glucose, mannose, rhamnose or xylose, more preferably a galactolipid containing galactose or glucose, most preferably a galactolipid containing galactose and others as aforementioned in the transgenic organisms by the process according to the invention in order to isolate high amounts of the pure fine chemical.

In another preferred embodiment of the invention a combination of the increased expression of the nucleic acid sequence or the protein of the invention together with the transformation of a nucleic acid encoding a protein or polypeptide for example another gene of the glycolipids containing galactose, glucose, mannose, rhamnose or xylose, more preferably a galactolipid containing galactose or glucose, most preferably a galactolipid containing galactose biosynthesis, or a compound, which functions as a sink for the desired glycolipids containing galactose, glucose, mannose, rhamnose or xylose, more preferably a galactolipid containing galactose or glucose, most preferably a galactolipid containing galactose in the organism is useful to increase the production of the respective fine chemical.

In a preferred embodiment, the respective fine chemical is produced in accordance with the invention and, if desired, is isolated. The production of further glycolipids other then glycolipids containing galactose, glucose, mannose, rhamnose or xylose, more preferably a galactolipid containing galactose or glucose, most preferably a galactolipid containing galactose or compounds for which the respective fine chemical is a biosynthesis precursor compounds, e.g. carbohydrates monosaccharides or sugar alcohols, or mixtures thereof or mixtures of other glycolipids, in particular of glycosphingolipids, sulfoglycosphingolipids, phosphoglycosphingolipids or glycophosphatidyl inositol, by the process according to the invention is advantageous.

In the case of the fermentation of microorganisms, the abovementioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fine chemical such as glycolipids containing galactose, glucose, mannose, rhamnose or xylose, more preferably a galactolipid containing galactose or glucose, most preferably a galactolipid containing galactose synthesized in the process according to the invention can advantageously be marketed directly without there being any need for the fine chemical synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, flowers, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

However, the respective fine chemical produced in the process according to the invention can also be isolated from the organisms, advantageously plants, (in the form of their organic extracts, e.g. alcohol, or other organic solvents or water containing extract and/or free glycolipids containing galactose, glucose, mannose, rhamnose or xylose, more preferably a galactolipid containing galactose or glucose, most preferably a galactolipid containing galactose or other extracts. The respective fine chemical produced by this process can be obtained by harvesting the organisms, either from the medium in which they grow, or from the field. This can be done via pressing or extraction of the plant parts. To increase the efficiency of extraction it is beneficial to clean, to temper and if necessary to hull and to flake the plant material. To allow for greater ease of disruption of the plant parts, specifically the seeds, they can previously be comminuted, steamed or roasted. Seeds, which have been pretreated in this manner can subsequently be pressed or extracted with solvents such as organic solvents like warm hexane or water or mixtures of organic solvents. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid.

Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose. However, it can be advantageous to avoid this treatment as it can result in cells devoid of most carotenoids.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention or the polypeptide used in the method of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 23, columns 5 and 7 or a fragment thereof, which confers an increase in the amount of the fine chemical in an organism or a part thereof;

b) nucleic acid molecule comprising, preferably at least the mature form, of the nucleic acid molecule shown in table I, application no. 23, columns 5 and 7;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers shown in table III, application no. 23, column 7 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence shown in table IV, application no. 23, column 7 and conferring an increase in the amount of the fine chemical in an organism or a part thereof;

k) nucleic acid molecule comprising one or more of the nucleic acid molecule encoding the amino acid sequence of a polypeptide encoding a domain of the polypeptide shown in table II, application no. 23, columns 5 and 7 and conferring an increase in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in table IA, application no. 23, columns 5 and 7 by one or more nucleotides. In one embodiment, the nucleic acid molecule used in the process of the invention does not consist of the sequence indicated in table IA, application no. 23, columns 5 and 7. In one embodiment, the nucleic acid molecule used in the process of the invention is less than 100%, 99.999%, 99.99%, 99.9% or 99% identical to a sequence indicated in table IA, application no. 23, columns 5 and 7. In another embodiment, the nucleic acid molecule does not encode a polypeptide of a sequence indicated in table IIA, application no. 23, columns 5 and 7.

In one embodiment, the nucleic acid molecule used in the process of the invention distinguishes over the sequence indicated in table IB, application no. 23, columns 5 and 7, by one or more nucleotides. In one embodiment, the nucleic acid molecule used in the process of the invention does not consist of the sequence indicated in table IB, application no. 23, columns 5 and 7. In one embodiment, the nucleic acid molecule used in the process of the invention is less than 100%, 99.999%, 99.99%, 99.9% or 99% identical to a sequence indicated in table IB, application no. 23, columns 5 and 7. In another embodiment, the nucleic acid molecule does not encode a polypeptide of a sequence indicated in table IIB, application no. 23, columns 5 and 7.

In one embodiment, the nucleic acid molecule used in the process distinguishes over the sequence shown in table I, application no. 23, columns 5 and 7 by one or more nucleotides or does not consist of the sequence shown in table I, application no. 23, columns 5 and 7. In one embodiment, the nucleic acid molecule of the present invention is less than 100%, 99.999%, 99.99%, 99.9% or 99% identical to the sequence shown in table I, application no. 23, columns 5 and 7. In another embodiment, the nucleic acid molecule does not encode a polypeptide of the sequence shown in table II, application no. 23, columns 5 and 7.

for the disclosure of the paragraphs [0118.0.0.22] to [0120.0.0.22] see paragraphs [0118.0.0.0] to [0120.0.0.0] above.

Nucleic acid molecules with the sequence shown in table I, application no. 23, columns 5 and 7, nucleic acid molecules which are derived from the amino acid sequences shown in table II, application no. 23, columns 5 and 7 or from polypeptides comprising the consensus sequence shown in table IV, application no. 23, column 7, or their derivatives or homologues encoding polypeptides with the enzymatic or biological activity of a protein as shown in table II, application no. 23, column 3 or conferring the fine chemical increase after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 23, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 23, column 3 and conferring the fine chemical increase by expression either in the cytsol or in an organelle such as a plastid or mitochondria or both, preferably in plastids.

for the disclosure of the paragraphs [0126.0.0.22] to [0133.0.0.22] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 23, columns 5 and 7 or the functional homologues thereof as described herein, preferably conferring above-mentioned activity, i.e. conferring the fine chemical increase after increasing its activity, e.g. after increasing the activity of a protein as shown in table II, application no. 23, column 3 by for example expression either in the cytsol or in an organelle such as a plastid or mitochondria or both, preferably in plastids.

for the disclosure of the paragraphs [0135.0.0.22] to [0140.0.0.22] see paragraphs [0135.0.0.0] to [0140.0.0.0] above.

Synthetic oligonucleotide primers for the amplification, e.g. as shown in table III, application no. 23, column 7, by means of polymerase chain reaction can be generated on the basis of a sequence shown herein, for example the sequence shown in table I, application no. 23, columns 5 and 7 or the sequences derived from table II, application no. 23, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 23, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 23, column 3 or further functional homologs of the polypeptide of the invention from other organisms.

for the disclosure of the paragraphs [0144.0.0.22] to [0151.0.0.22] see paragraphs [0144.0.0.0] to [0151.0.0.0] above.

Polypeptides having above-mentioned activity, i.e. conferring the fine chemical increase, derived from other organisms, can be encoded by other DNA sequences which hybridize to the sequences shown in table I, application no. 23, columns 5 and 7, preferably of table IB, application no. 23, columns 5 and 7 under relaxed hybridization conditions and which code on expression for peptides having the glycolipids containing galactose, glucose, mannose, rhamnose or xylose, more preferably a galactolipid containing galactose or glucose, most preferably a galactolipid containing galactose increasing activity.

for the disclosure of the paragraphs [0153.0.0.22] to [0159.0.0.22] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 23, columns 5 and 7, preferably shown in table IB, application no. 23, columns 5 and 7 is one which is sufficiently complementary to one of the nucleotide sequences shown in table I, application no. 23, columns 5 and 7, preferably shown in table IB, application no. 23, columns 5 and 7 such that it can hybridize to one of the nucleotide sequences shown in table I, application no. 23, columns 5 and 7, preferably shown in table IB, application no. 23, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 23, columns 5 and 7, preferably shown in table IB, application no. 23, columns 5 and 7, or a portion thereof and preferably has above mentioned activity, in particular having a fine chemical increasing activity after increasing the activity or an activity of a gene product as shown in table II, application no. 23, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 23, columns 5 and 7, preferably shown in table IB, application no. 23, columns 5 and 7, or a portion thereof and encodes a protein having above-mentioned activity, e.g. conferring of a glycolipid increase by for example expression either in the cytsol or in an organelle such as a plastid or mitochondria or both, preferably in plastids, and optionally, the activity of a protein as shown in table II, application no. 23, column 3.

Moreover, the nucleic acid molecule of the invention can comprise only a portion of the coding region of one of the sequences shown in table I, application no. 23, columns 5 and 7, preferably shown in table IB, application no. 23, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 23, columns 5 and 7, an anti-sense sequence of one of the sequences, e.g., set forth in table I, application no. 23, columns 5 and 7, preferably shown in table IB, application no. 23, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table II, application no. 23, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 23, columns 5 and 7 such that the protein or portion thereof maintains the ability to participate in the fine chemical production, in particular a glycolipid increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 23, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 23, columns 5 and 7 and having above-mentioned activity, e.g. conferring preferably the increase of the fine chemical by for example expression either in the cytsol or in an organelle such as a plastid or mitochondria or both, preferably in plastids.

for the disclosure of the paragraphs [0168.0.0.22] and [0169.0.0.22] see paragraphs [0168.0.0.0] and [0169.0.0.0] above.

The invention further relates to nucleic acid molecules that differ from one of the nucleotide sequences shown in table I, application no. 23, columns 5 and 7 (and portions thereof) due to degeneracy of the genetic code and thus encode a polypeptide of the present invention, in particular a polypeptide having above mentioned activity, e.g. conferring an increase in the fine chemical in a organism, e.g. as that polypeptides depicted by the sequence shown in table II, application no. 23, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 23, columns 5 and 7 or the functional homologues. In a still further embodiment, the nucleic acid molecule of the invention encodes a full length protein which is substantially homologous to an amino acid sequence shown in table II, application no. 23, columns 5 and 7 or the functional homologues. However, in a preferred embodiment, the nucleic acid molecule of the present invention does not consist of the sequence shown in table I, application no. 23, columns 5 and 7, preferably as indicated in table IA, application no. 23, columns 5 and 7. Preferably the nucleic acid molecule of the invention is a functional homologue or identical to a nucleic acid molecule indicated in table IB, application no. 23, columns 5 and 7.

for the disclosure of the paragraphs [0171.0.0.22] to [0173.0.0.22] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 23, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 23, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 23, columns 5 and 7.

for the disclosure of the paragraphs [0179.0.0.22] and [0180.0.0.22] see paragraphs [0179.0.0.0] and [0180.0.0.0] above.

Accordingly, the invention relates to nucleic acid molecules encoding a polypeptide having above-mentioned activity, e.g. conferring an increase in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 23, columns 5 and 7, preferably shown in table IIA, application no. 23, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 23, columns 5 and 7, preferably shown in table IIA, application no. 23, columns 5 and 7 and is capable of participation in the increase of production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, application no. 23, columns 5 and 7, preferably shown in table IIA, application no. 23, columns 5 and 7, more preferably at least about 70% identical to one of the sequences shown in table II, application no. 23, columns 5 and 7, preferably shown in table IIA, application no. 23, columns 5 and 7, even more preferably at least about 80%, 90%, 95% homologous to the sequence shown in table II, application no. 23, columns 5 and 7, preferably shown in table IIA, application no. 23, columns 5 and 7, and most preferably at least about 96%, 97%, 98%, or 99% identical to the sequence shown in table II, application no. 23, columns 5 and 7, preferably shown in table IIA, application no. 23, columns 5 and 7.

for the disclosure of the paragraphs [0182.0.0.22] to [0188.0.0.22] see paragraphs [0182.0.0.0] to [0188.0.0.0] above.

Functional equivalents derived from one of the polypeptides as shown in table II, application no. 23, columns 5 and 7, preferably shown in table IIB, application no. 23, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 23, columns 5 and 7, preferably shown in table IIB, application no. 23, columns 5 and 7 resp., according to the invention and are distinguished by essentially the same properties as the polypeptide as shown in table II, application no. 23, columns 5 and 7, preferably shown in table IIB, application no. 23, columns 5 and 7.

Functional equivalents derived from the nucleic acid sequence as shown in table I, application no. 23, columns 5 and 7, preferably shown in table IB, application no. 23, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 23, columns 5 and 7, preferably shown in table IIB, application no. 23, columns 5 and 7 resp., according to the invention and encode polypeptides having essentially the same properties as the polypeptide as shown in table II, application no. 23, columns 5 and 7, preferably shown in table IIB, application no. 23, columns 5 and 7.

for the disclosure of this paragraph see paragraph [0191.0.0.0] above.

A nucleic acid molecule encoding an homologous to a protein sequence of table II, application no. 23, columns 5 and 7, preferably shown in table IIB, application no. 23, columns 5 and 7 resp., can be created by introducing one or more nucleotide substitutions, additions or deletions into a nucleotide sequence of the nucleic acid molecule of the present invention, in particular of table I, application no. 23, columns 5 and 7, preferably shown in table IB, application no. 23, columns 5 and 7 resp., such that one or more amino acid substitutions, additions or deletions are introduced into the encoded protein. Mutations can be introduced into the encoding sequences of table I, application no. 23, columns 5 and 7, preferably shown in table IB, application no. 23, columns 5 and 7 resp., by standard techniques, such as site-directed mutagenesis and PCR-mediated mutagenesis.

for the disclosure of the paragraphs [0193.0.0.22] to [0196.0.0.22] see paragraphs [0193.0.0.0] to [0196.0.0.0] above.

Homologues of the nucleic acid sequences used, with the sequence shown in table I, application no. 23, columns 5 and 7, preferably shown in table IB, application no. 23, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 23, columns 5 and 7, preferably shown in table IB, application no. 23, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 23, columns 5 and 7, preferably shown in table IB, application no. 23, columns 5 and 7. It is preferred that the nucleic acid molecule comprises as little as possible other nucleotides not shown in any one of table I, application no. 23, columns 5 and 7, preferably shown in table IB, application no. 23, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 23, columns 5 and 7, preferably shown in table IB, application no. 23, columns 5 and 7.

Also preferred is that the nucleic acid molecule used in the process of the invention encodes a polypeptide comprising the sequence shown in table II, application no. 23, columns 5 and 7, preferably shown in table IIB, application no. 23, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 23, columns 5 and 7, preferably shown in table IIB, application no. 23, columns 5 and 7.

In one embodiment, the nucleic acid molecule of the invention or used in the process encodes a polypeptide comprising the sequence shown in table II, application no. 23, columns 5 and 7, preferably shown in table IIB, application no. 23, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 23, columns 5 and 7, preferably shown in table IB, application no. 23, columns 5 and 7.

Polypeptides (=proteins), which still have the essential biological or enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 23, columns 5 and 7 expressed under identical conditions.

Homologues of table I, application no. 23, columns 5 and 7 or of the derived sequences of table II, application no. 23, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.22] to [0215.0.0.22] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 23, columns 5 and 7, preferably in table IIB, application no. 23, columns 5 and 7; or a fragment thereof conferring an increase in the amount of the fine chemical in an organism or a part thereof b) nucleic acid molecule comprising, preferably at least the mature form, of the nucleic acid molecule shown in table I, application no. 23, columns 5 and 7, preferably in table IB, application no. 23, columns 5 and 7 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using the primers in table II, application no. 23, column 7 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 23, column 7 and conferring an increase in the amount of the fine chemical in an organism or a part thereof;

k) nucleic acid molecule encoding the amino acid sequence of a polypeptide encoding a domain of the polypeptide shown in table II, application no. 23, columns 5 and 7 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 23, columns 5 and 7 or a nucleic acid molecule encoding, preferably at least the mature form of, the polypeptide shown in table II, application no. 23, columns 5 and 7, and conferring an increase in the amount of the fine chemical in an organism or a part thereof; or which encompasses a sequence which is complementary thereto; whereby, preferably, the nucleic acid molecule according to (a) to (l) distinguishes over the sequence depicted in table IA and/or IB, application no. 23, columns 5 and 7 by one or more nucleotides. In one embodiment, the nucleic acid molecule of the invention does not consist of the sequence shown in table IA and/or IB, application no. 23, columns 5 and 7. In another embodiment, the nucleic acid molecule of the present invention is at least 30% identical and less than 100%, 99.999%, 99.99%, 99.9% or 99% identical to the sequence shown in table IA and/or IB, application no. 23, columns 5 and 7. In a further embodiment the nucleic acid molecule does not encode the polypeptide sequence shown in table IIA and/or IIB, application no. 23, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 23, columns 5 and 7 does not encode a protein of the sequence shown in table IIA and/or IIB, application no. 23, columns 5 and 7. Accordingly, in one embodiment, the protein encoded by a sequence of a nucleic acid accoriding to (a) to (l) does not consist of the sequence shown in table IA and/or IB, application no. 23, columns 5 and 7. In a further embodiment, the protein of the present invention is at least 30% identical to protein sequence depicted in table IIA and/or IIB, application no. 23, columns 5 and 7 and less than 100%, preferably less than 99.999%, 99.99% or 99.9%, more preferably less than 99%, 985, 97%, 96% or 95% identical to the sequence shown in table IIA and/or IIB, application no. 23, columns 5 and 7.

for the disclosure of the paragraphs [0217.0.0.22] to [0226.0.0.22] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 23, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.22] to [0239.0.0.22] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 23, columns 5 and 7 or its derivatives, it is advantageous additionally to express and/or mutate further genes in the organisms. Especially advantageously, additionally at least one further gene of the glycolipids biosynthetic pathway is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the respective desired fine chemical since, for example, feedback regulations no longer exist to the same extent or not at all. In addition it might be advantageously to combine the sequences shown in Table I, application no. 23, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous direct or indirect overexpression of at least one nucleic acid or one of the genes which code for proteins involved in the glycolipids metabolism, in particular in synthesis of glycolipids containing galactose, glucose, mannose, rhamnose or xylose, more preferably a galactolipid containing galactose or glucose, most preferably a galactolipid containing galactose. Indirect overexpression might be brought about by the manipulation of the regulation of the endogenous gene, for example through promotor mutations or the expression of natural or artificial transcriptional regulators.

Further advantageous nucleic acid sequences which can be expressed in combination with the sequences used in the process and/or the abovementioned biosynthesis genes are the sequences encoding further genes of the glycolipid biosynthetic pathway.

In a further advantageous embodiment of the process of the invention, the organisms used in the process are those in which advantageously simultaneously a glycolipid degrading protein is attenuated, in particular by reducing the rate of expression of the corresponding gene, or by inactivating the gene for example the mutagenesis and/or selection. In another advantageous embodiment the synthesis of competitive pathways which rely on the same precursors are down regulated or interrupted.

The respective fine chemical produced can be isolated from the organism by methods with which the skilled worker are familiar, for example via extraction, salt precipitation, and/or different chromatography methods. The process according to the invention can be conducted batchwise, semibatchwise or continuously. The fine chemcical and other glycolipids produced by this process can be obtained by harvesting the organisms, either from the crop in which they grow, or from the field. This can be done via for example pressing or extraction of the plant parts.

Preferably, the compound is a composition comprising the essentially pure glycolipids containing galactose, glucose, mannose, rhamnose or xylose, more preferably a galactolipid containing galactose or glucose, most preferably a galactolipid containing galactose or a recovered or isolated glycolipids containing galactose, glucose, mannose, rhamnose or xylose, more preferably a galactolipid containing galactose or glucose, most preferably a galactolipid containing galactose.

for the disclosure of the paragraphs [0243.0.0.22] to [0264.0.0.22] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 23, columns 5 and 7 and described herein to achieve an expression in one of said compartments or extracellular.

for the disclosure of the paragraphs [0266.0.0.22] to [0287.0.0.22] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 23, columns 5 and 7 or their homologs is functionally linked to a plastidial targeting sequence. A further preferred embodiment of the invention relates to a vector in which a nucleic acid sequence encoding one of the polypeptides shown in table II, application no. 23, columns 5 and 7 or their homologs is functionally linked to a regulatory sequences which permit the expression in plastids.

for the disclosure of the paragraphs [0289.0.0.22] to [0296.0.0.22] see paragraphs [0289.0.0.0] to [0296.0.0.0] above.

Moreover, native polypeptide conferring the increase of the fine chemical in an organism or part thereof can be isolated from cells (e.g., endothelial cells), for example using the antibody of the present invention as described below, in particular, an anti-b3708 protein antibody or an antibody against polypeptides as shown in table II, application no. 23, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 23, columns 5 and 7 or as coded by the nucleic acid molecule shown in table I, application no. 23, columns 5 and 7 or functional homologues thereof.

In one advantageous embodiment, in the method of the present invention the activity of a polypeptide is increased comprising or consisting of the consensus sequence shown in table IV, application no. 23, columns 7 and in one another embodiment, the present invention relates to a polypeptide comprising or consisting of the consensus sequence shown in table IV, application no. 23, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.22] to [0304.0.0.22] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 23, columns 5 and 7 by one or more amino acids. In one embodiment, polypeptide distinguishes form the sequence shown in table IIA and/or IIB, application no. 23, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 23, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 23, columns 5 and 7.

for the disclosure of this paragraph see paragraph [0306.0.0.0] above.

In one embodiment, the invention relates to polypeptide conferring an increase in the fine chemical in an organism or part being encoded by the nucleic acid molecule of the invention or used in the process of the invention and having a sequence which distinguishes from the sequence as shown in table IIA and/or IIB, application no. 23, columns 5 and 7 by one or more amino acids. In another embodiment, said polypeptide of the invention does not consist of the sequence shown in table IIA and/or IIB, application no. 23, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 23, columns 5 and 7.

In one embodiment, the present invention relates to a polypeptide having the activity of the protein as shown in table IIA and/or IIB, application no. 23, column 3, which distinguishes over the sequence depicted in table IIA and/or IIB, application no. 23, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle for example into the plastid or mitochondria.

for the disclosure of the paragraphs [0309.0.0.22] to [0311.0.0.22] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 23, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 23, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 23, columns 5 and 7 or which is homologous thereto, as defined above.

Accordingly the polypeptide of the present invention can vary from the sequences shown in table IIA and/or IIB, application no. 23, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 23, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 23, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 23, column 3. Differences shall mean at least one amino acid different from the sequences as shown in table II, application no. 23, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 23, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 23, column 3. The nucleic acid molecules and polypeptide molecules of the invention are expressed such that the yield, production, and/or efficiency of production of a desired compound is improved.

for the disclosure of the paragraphs [0320.0.0.22] to [0322.0.0.22] see paragraphs [0320.0.0.0] to [0322.0.0.0] above.

In one embodiment, a protein (=polypeptide) as shown in table II, application no. 23, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 23, column 3, e.g., a protein which does not confer the activity described herein and which is derived from the same or a different organism.

for the disclosure of the paragraphs [0324.0.0.22] to [0329.0.0.22] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 23, columns 5 and 7.

for the disclosure of the paragraphs [0331.0.0.22] to [0346.0.0.22] see paragraphs [0331.0.0.0] to [0346.0.0.0] above.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 23, column 3. Due to the above mentioned activity the fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 23, column 3 or a protein as shown in table II, application no. 23, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 23, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.22] to [0358.0.0.22] see paragraphs [0350.0.0.0] to [0358.0.0.0] above.

Transgenic plants comprising glycolipids containing galactose, glucose, mannose, rhamnose or xylose, more preferably a galactolipid containing galactose or glucose, most preferably a galactolipid containing galactose or mixtures thereof synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The glycolipids containing galactose, glucose, mannose, rhamnose or xylose, more preferably a galactolipid containing galactose or glucose, most preferably a galactolipid containing galactose produced in the process according to the invention may, however, also be isolated from the plant in the form of their free glycolipids containing galactose, glucose, mannose, rhamnose or xylose, more preferably a galactolipid containing galactose or glucose, most preferably a galactolipid containing galactose produced by this process can be isolated by harvesting the plants either from the culture in which they grow or from the field. This can be done for example via expressing, grinding and/or extraction of the plant parts, preferably the plant leaves, plant fruits, flowers and the like.

The invention furthermore relates to the use of the transgenic plants according to the invention and of the cells, cell cultures, parts—such as, for example, roots, leaves, flowers and the like as mentioned above in the case of transgenic plant organisms—derived from them, and to transgenic propagation material such as seeds or fruits and the like as mentioned above, for the production of foodstuffs or feeding stuffs, cosmetics, pharmaceuticals or fine chemicals.

for the disclosure of the paragraphs [0360.0.0.22] to [0362.0.0.22] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the glycolipids produced in the process can be isolated. The resulting fine chemical can, if appropriate, subsequently be further purified, if desired mixed with other active ingredients such as other xanthophylls, fatty acids, vitamins, amino acids, carbohydrates, antibiotics and the like, and, if appropriate, formulated.

In one embodiment, glycolipids containing galactose, glucose, mannose, rhamnose or xylose, more preferably a galactolipid containing galactose or glucose, most preferably a galactolipid containing galactose is the fine chemical.

The glycolipids, in particular the respective fine chemicals obtained in the process are suitable as starting material for the synthesis of further products of value. For example, they can be used in combination with each other or alone for the production of pharmaceuticals, health products, foodstuffs, animal feeds, nutrients or cosmetics. Accordingly, the present invention relates a method for the production of pharmaceuticals, health products, food stuff, animal feeds, nutrients or cosmetics comprising the steps of the process according to the invention, including the isolation of the glycolipids containing, in particular glycolipids containing galactose, glucose, mannose, rhamnose or xylose, more preferably a galactolipid containing galactose or glucose, most preferably a galactolipid containing galactose containing composition produced or the respective fine chemical produced if desired and formulating the product with a pharmaceutical acceptable carrier or formulating the product in a form acceptable for an application in agriculture. A further embodiment according to the invention is the use of the glycolipids produced in the process or of the transgenic organisms in animal feeds, foodstuffs, medicines, food supplements, cosmetics or pharmaceuticals.

for the disclosure of the paragraphs [0366.0.0.22] to [0369.0.0.22] see paragraphs [0366.0.0.0] to [0369.0.0.0] above.

The fermentation broths obtained in this way, containing in particular glycolipids containing galactose, glucose, mannose, rhamnose or xylose, more preferably a galactolipid containing galactose or glucose, most preferably a galactolipid containing galactose in mixtures with other organic acids, amino acids, polypeptides or polysaccharides, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the glycolipids, in particular the glycolipids containing galactose, glucose, mannose, rhamnose or xylose, more preferably a galactolipid containing galactose or glucose, most preferably a galactolipid containing galactose produced according to the invention further. For this purpose, the product-containing composition, e.g. a total or partial extraction fraction using organic solvents, is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.22] to [0376.0.0.22], [0376.1.0.22] and [0377.0.0.22] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 23, columns 5 and 7, preferably in table IB, application no. 23, columns 5 and 7, and, optionally, isolating the full length cDNA clone or complete genomic clone;
(c) introducing the candidate nucleic acid molecules in host cells, preferably in a plant cell or a microorganism, appropriate for producing the fine chemical;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

for the disclosure of the paragraphs [0379.0.0.22] to [0383.0.0.22] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 23, column 3, e.g. comparing near identical organisms with low and high activity of the proteins as shown in table II, application no. 23, column 3.

for the disclosure of the paragraphs [0385.0.0.22] to [0404.0.0.22] see paragraphs [0385.0.0.0] to [0404.0.0.0] above.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other glycolipids, in particular glycolipids such as glycosphingolipids, sulfoglycosphingolipids, phosphoglycosphingolipids or glycophosphatidyl inositol.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorgansms, the plant, plant tissue, plant cell, or the part thereof of the invention, the vector of the invention, the agonist identified with the method of the invention, the antibody of the present invention, can be used for the reduction of the fine chemical in an organism or part thereof, e.g. in a cell.

for the disclosure of the paragraphs [0406.0.0.22] to [0435.0.0.22] see paragraphs [0406.0.0.0] to [0435.0.0.0] above.

Production of Glycolipids Containing Galactose in *Chlamydomonas reinhardtii*

The glycolipids production can be analysed as mentioned herein.

The proteins and nucleic acids can be analysed as mentioned below.

In addition a production in other organisms such as plants or microorganisms such as yeast, *Mortierella* or *Escherichia coli* is possible.

for the disclosure of the paragraphs [0437.0.0.22] and [0438.0.0.22] see paragraphs [0437.0.0.0] and [0438.0.0.0] above.

Example 9

Analysis of the Effect of the Nucleic Acid Molecule on the Production of Glycolipids The effect of the genetic modification of plants or algae on the production of a desired compound (such as glycolipids containing galactose, glucose, mannose, rhamnose or xylose, more preferably a galactolipid containing galactose or glucose, most preferably a galactolipid containing galactose) can be determined by growing the modified plant under suitable conditions (such as those described above) and analyzing the medium and/or the cellular components for the elevated production of desired product (i.e. of glycolipids containing galactose, glucose, mannose, rhamnose or xylose, more preferably a galactolipid containing galactose or glucose, most preferably a galactolipid containing galactose). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications) or the methods mentioned above.

for the disclosure of this paragraph see [0441.0.0.0] above.

Purification of and determination of the glycolipid content:

One example is the analysis of glycolipids containing galactose, glucose, mannose, rhamnose or xylose, more preferably a galactolipid containing galactose or glucose, most preferably a galactolipid containing galactose (abbreviations: FAME, fatty acid methyl ester; GC-MS, gas liquid chromatography/mass spectrometry; TAG, triacylglycerol; TLC, thin-layer chromatography).

The unambiguous detection for the presence of fatty acid products can be obtained by analyzing recombinant organisms using analytical standard methods: GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353).

The total fatty acids produced in the organism for example in yeasts used in the inventive process can be analysed for example according to the following procedure:

The material such as yeasts, E. coli or plants to be analyzed can be disrupted by sonication, grinding in a glass mill, liquid nitrogen and grinding or via other applicable methods. After disruption, the material must be centrifuged (1000×g, 10 min., 4° C.) and washed once with 100 mM NaHCO$_3$, pH 8.0 to remove residual medium and fatty acids. For preparation of the fatty acid methyl esters (FAMES) the sediment is resuspended in distilled water, heated for 10 minutes at 100° C., cooled on ice and recentrifuged, followed by extraction for one hour at 90° C. in 0.5 M sulfuric acid in methanol with 2% dimethoxypropane, which leads to hydrolyzed oil and lipid compounds, which give transmethylated lipids.

The FAMES are then extracted twice with 2 ml petrolether, washed once with 100 mM NaHCO$_3$, pH 8.0 and once with distilled water and dried with Na$_2$SO$_4$. The organic solvent can be evaporated under a stream of Argon and the FAMES were dissolved in 50 µl of petrolether. The samples can be separated on a ZEBRON ZB-Wax capillary column (30 m, 0.32 mm, 0.25 µm; Phenomenex) in a Hewlett Packard 6850 gas chromatograph with a flame ionisation detector. The oven temperature is programmed from 70° C. (1 min. hold) to 200° C. at a rate of 20° C./min., then to 250° C. (5 min. hold) at a rate of 5° C./min and finally to 260° C. at a rate of 5° C./min. Nitrogen is used as carrier gas (4.5 ml/min. at 70° C.). The identity of the resulting fatty acid methyl esters can be identified by comparison with retention times of FAME standards, which are available from commercial sources (i.e. Sigma).

Plant material is initially homogenized mechanically by comminuting in a pestle and mortar to make it more amenable to extraction.

This is followed by heating at 100° C. for 10 minutes and, after cooling on ice, by resedimentation. The cell sediment is hydrolyzed for one hour at 90° C. with 1 M methanolic sulfuric acid and 2% dimethoxypropane, and the lipids are transmethylated. The resulting fatty acid methyl esters (FAMEs) are extracted in petroleum ether. The extracted FAMEs are analyzed by gas liquid chromatography using a capillary column (Chrompack, WCOT Fused Silica, CP-Wax-52 CB, 25 m, 0.32 mm) and a temperature gradient of from 170° C. to 240° C. in 20 minutes and 5 minutes at 240° C. The identity of the fatty acid methyl esters is confirmed by comparison with corresponding FAME standards (Sigma).

The identity and position of the double bond can be analyzed further by suitable chemical derivatization of the FAME mixtures, for example to give 4,4-dimethoxyoxazoline derivatives (Christie, 1998) by means of GC-MS.

The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2): 293-298 and Michaelson et al., 1998, FEBS Letters. 439(3): 215-218.

If required and desired, further chromatography steps with a suitable resin may follow. Advantageously the lipid, preferably a glycolipid, glycolipid containing galactose, more preferably a galactolipide and/or cerebroside can be further purified with a so-called RTHPLC. As eluent different an acetonitrile/water or chloroform/acetonitrile mixtures are advantageously is used. For the analysis of the fatty acids an ELSD detector (evaporative light-scattering detector) is used. MPLC, dry-flash chromatography or thin layer chromatography are other beneficial chromatography methods for the purification of glycolipids. If necessary, these chromatography steps may be repeated, using identical or other chromatography resins. The skilled worker is familiar with the selection of suitable chromatography resin and the most effective use for a particular molecule to be purified.

A typical sample pretreatment consists of a total lipid extraction using such polar organic solvents as acetone or alcohols as methanol, or ethers, saponification, partition between phases, seperation of non-polar epiphase from more polar hypophasic derivatives and chromatography. E.g.:

For analysis, solvent delivery and aliquot removal can be accomplished with a robotic system comprising a single injector valve Gilson 232XL and a 402 2S1V diluter [Gilson, Inc. USA, 3000 W. Beltline Highway, Middleton, Wis.]. For saponification, 3 ml of 50% potassium hydroxide hydro-ethanolic solution (4 water:1 ethanol) can be added to each vial, followed by the addition of 3 ml of octanol. The saponification treatment can be conducted at room temperature with vials maintained on an IKA HS 501 horizontal shaker [Labworld-online, Inc., Wilmington, N.C.] for fifteen hours at 250 movements/minute, followed by a stationary phase of approximately one hour.

Following saponification, the supernatant can be diluted with 0.10 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol:4 water:15 tetrahydrofuran (THF) stabilized with 0.2% BHT (2,6-di-tert-butyl-4-methylphenol). Injections were 20 µl. Separation can be isocratic at 30° C. with a flow rate of 1.7 ml/minute. The peak responses can be measured by absorbance at 447 nm.

One example is the analysis of the coenzymes. The unambiguous detection for the presence of the coenzymes products can be obtained by analyzing recombinant organisms using analytical standard methods, especially HPLC with UV or electrochemical detection as for example described in The Journal of Lipid Research, Vol. 39, 2099-2105, 1998.

Possible methods for the production and preparation of coenzymes like Coenzyme Q10 has also been described for example in WO2003056024, J57129695, J57202294, DE3416853 and DD-229152. Further methods for the isolation of the respective fine chemical can also been found in WO 9500634, Fat-Sci. Technol.; (1992) 94, 4, 153-57, DD-294280, DD-293048, JP-145413, DD-273002, DD-271128, SU1406163, JP-166837, JP-176705, Acta-Biotechnol.; (1986) 6, 3, 277-79, DD-229152, DE3416854, DE3416853, JP-202840, JP-048433, JP-125306, JP-087137, JP-014026, WO2003056024 and WO200240682.

Plant material is initially homogenized mechanically by comminuting in a pestle and mortar to make it more amenable to extraction.

for the disclosure of the paragraphs [0446.0.0.22] to [0496.0.0.22] see paragraphs [0446.0.0.0] to [0496.0.0.0] above.

In order to analyze glycolipids being present in the transgenic organism by the means of gas chromatography-mass spectrometry, material from the transgenic organisms have to be extracted and the extracts subsequently being hydrolyzed in the presence of methanol and an inorganic acid, yielding the corresponding fatty acid methyl esters and the respective monosaccharid moiety as its methylhexopyranoside.

Primary and secondary amino functions, hydroxy groups and free carboxylic functions eventually will be trimethylsilylated by reaction with N-Methyl-N-trimethylsilyltrifluoroacetamide, yielding the trimethylsilyl (TMS) derivatives of the methylhexopyranosides formed in the previous hydrolysis step (eg methylgalactopyranoside 4TMS in the case of a galactolipid). These compounds are accessible to gas chromatographic-mass spectrometric analysis.

Therefore, an increased content of the trimethylsilylated methylhexopyranosides directly correlates to an increased content of glycolipids in the transgenic organism.

The results of the different plant analyses can be seen from the table, which follows:

TABLE VI

| ORF | Metabolite | Method | Min | Max |
|---|---|---|---|---|
| b3708 | Methylgalactopyranosid, from Galactolipids | GC | 1.14 | 1.34 | for the disclosure of the paragraphs [0499.0.0.22] and [0500.0.0.22] see paragraphs [0499.0.0.0] and [0500.0.0.0] above.

Example 15a

Engineering Ryegrass Plants by Over-Expressing b3708 from *Escherichia coli* or Homologs of b3708 from Other Organisms for the disclosure of the paragraphs [0502.0.0.22] to [0508.0.0.22] see paragraphs [0502.0.0.0] to [0508.0.0.0] above.

Example 15b

Engineering Soybean Plants by Over-expressing b3708 from *Escherichia coli* or Homologs of b3708 from Other Organisms for the disclosure of the paragraphs [0510.0.0.22] to [0513.0.0.22] see paragraphs [0510.0.0.0] to [0513.0.0.0] above.

Example 15c

Engineering Corn Plants by Over-Expressing b3708 from *Escherichia coli* or Homologs of b3708 from Other Organisms for the disclosure of the paragraphs [0515.0.0.22] to [0540.0.0.22] see paragraphs [0515.0.0.0] to [0540.0.0.0] above.

Example 15d

Engineering Wheat Plants by Over-Expressing b3708 from *Escherichia coli* or Homologs of b3708 from Other Organisms for the disclosure of the paragraphs [0542.0.0.22] to [0544.0.0.22] see paragraphs [0542.0.0.0] to [0544.0.0.0] above.

Example 15e

Engineering Rapeseed/Canola Plants by Over-Expressing b3708 from *Escherichia coli* or Homologs of b3708 from Other Organisms for the disclosure of the paragraphs [0546.0.0.22] to [0549.0.0.22] see paragraphs [0544.0.0.0] to [0549.0.0.0] above.

Example 15f

Engineering Alfalfa Plants by Over-Expressing b3708 from *Escherichia coli* or Homologs of b3708 from Other Organisms for the disclosure of the paragraphs [0551.0.0.22] to [0554.0.0.22] see paragraphs [0551.0.0.0] to [0554.0.0.0] above.

% for the disclosure of this paragraph see [0554.2.0.0] above.
for the disclosure of this paragraph see [0555.0.0.0] above.
for the disclosure of this paragraph see [0001.0.0.0].

Salicylic acid is common throughout the plant kingdom and is also found in bacteria. It is an important regulator of induced plant resistance to pathogens. Small amounts of salicylic acid are known to be present in plants. Originally salicylic acid was extracted from the willow bark to make the well-known pain relief medication Aspirin. Salicylic acid is thought to promote disease resistance, increase flower life, inhibit seed germination, and promote ethylene synthesis.

Salicylic acid can be synthesized from cinnamate. Previous isotope feeding experiments in tobacco and other higher plants, including rice, demonstrated that the direct precursor of salicylic acid is free benzoic acid. Benzoic acid is synthesized by cinnamate chain shortening reactions via the so-called beta-oxidation, analogous to fatty acid beta-oxidation.

Benzoic acid is then converted to salicylic acid by benzoic acid 2-hydroxylase. Recent studies in tobacco indicated that conjugated benzoic acid, CoA thioesters or glucose esters, are more likely to be the precursors of salicylic acid. More recent genetic studies in *Arabidopsis* have shown that salicylic acid can also be synthesized from chorismate and that the bulk of salicylic acid is produced from chorismate.

Plants react to pathogen attack by activating elaborate defense mechanisms. The defense response is activated not only at the sites of infection, but also in neighboring and even distal uninfected parts of the plant, leading to systemic acquired resistance. Plant resistance is associated with activated expression of a large number of defense-related genes, whose products may play important roles in the restriction of pathogen growth and spread. During the past several years, evidence has accumulated which indicates that salicylic acid (SA) acts as an endogenous signal for plant defense responses.

In most plants, exposure to powdery mildew and other pathogens triggers the plant defense pathway, a series of biochemical events that occur in succession and help the plant resist infection. Salicylic acid governs this pathway.

Where resistance to a pathogen is associated with a localised necrotic lesion, the plant will subsequently be systemically "immunized" so that further infection will either exhibit increased resistance or reduced disease symptoms (reviewed by Ryals et al., 1996). This "systemic acquired resistance" (SAR) is associated with the systemic expression of a subset of defense genes, e.g. the acidic forms of pathogenesis-related PR1-5 proteins (Ward et al., 1992). Search for a signal that may be mobilized from the lesion to elicit systemic resistance has led to the identification of salicylic acid (SA) as the most likely candidate. SA is synthesised to high levels around the necrotic lesion, before being (possibly) mobilized through the phloem to accumulate, at much lower levels, systemically.

When faced with a fungus or bacteria, most plants turn up their production of salicylic acid, which then interacts with other molecules in the plant, eventually turning on the genes that produce the proteins involved in fighting infection. These infection-fighting proteins also turn off salicylic acid production, a phenomenon known as negative feedback. In this way, plants can turn the pathogen defense pathway on and off as needed.

The basic idea to enhance plant disease resistance by over-production of salicylic acid has already been published years ago for example by Verberne et al., Pharm. World-Sci.; (1995) 17, 6. Later on in 2000 is was published that the expression of the *Escherichia coli* isochorismate-synthase and *Pseudomonas fluorescence* isochorismate-pyruvate-lyase in transgenic tobacco can lead to improved disease-resistance (Verberne, M et al., Nat. Biotechnol.; (2000) 18, 7, 779-83. The two enzymes converted chorismate into SA by a 2-step process. When the enzymes were targeted to the chloroplasts, the transgenic plants showed a 500- to 1,000-fold increased accumulation of SA and SA glucoside compared to control plants. These plants showed a resistance to viral (tobacco-mosaic virus) and fungal (*Oidium lycopersicon*) infection resembling SAR in nontransgenic plants. As the effect was the result of the plastidal expression of two heterologous genes, there is the obvious need for alternative and more simple methods for enhanced salicylic acid production in plants by the cytosolic expression of individual genes. For individual cases or specific plant species a more moderate salicylic acid increase may also be useful and desired.

Additionally salicylic acid binding proteins have been described as useful for the production of transgenic plants with increased resistance to disease (WO2003016551). Most plants maintain very low levels of salicylic acid in their tissues unless they are fighting an infection. Metal hyperaccumulators, however, have significantly elevated salicylic acid in their tissues all the time—see:
www.newswise.com/articles/view/510423/

Recent results also suggest that in some plant species high level of endogenous salicylic acid protects the plants from oxidative stress caused for example by aging or biotic or abiotic stress (Yang et al., Plant J. 2004 December; 40 (6): 909-19).

Aspirin was introduced into clinical practice more than 100 years ago. This unique drug belongs to a family of compounds called the salicylates, the simplest of which is salicylic acid, the principal metabolite of aspirin. Salicylic acid is responsible for the anti-inflammatory action of aspirin, and may cause the reduced risk of colorectal cancer observed in those who take aspirin. Yet salicylic acid and other salicylates occur naturally in fruits and plants, while diets rich in these are believed to reduce the risk of colorectal cancer. Serum salicylic acid concentrations are greater in vegetarians than non-vegetarians, and there is overlap between concentrations in vegetarians and those taking low-dose aspirin. It is proposed that the cancer-preventive action of aspirin is due to its principal metabolite, salicylic acid, and that dietary salicylates can have the same effect. It is also possible that natural salicylates contribute to the other recognized benefits of a healthy diet.

The hydroxyl group of salicylic acid reacts with acetic acid to form the acetate ester, acetylsalicylic acid (see aspirin). Several useful esters are formed by reaction of the carboxyl group with alcohols. The methyl ester, methyl salicylate (also called oil of wintergreen since it produces the fragrance of wintergreen), is formed with methanol; it is used in food flavorings and in liniments. The phenyl ester, phenyl salicylate, or salol, is formed with phenol; it is used in medicine as an antiseptic and antipyretic. This ester hydrolyzes, not in the acidic stomach, but in the alkaline intestines, releasing free salicylic acid. The menthyl ester, menthyl salicylate, which is used in suntan lotions, is formed with menthol.

Salicylic acid possesses bacteriostatic, fungicidal, and keratolytic actions.

Salicylic acid is used as a food preservative and as an antiseptic in toothpaste. It is a peeling agent in ointments, creams, gels, and shampoos applied to reduce the scaling of the skin or scalp in psoriasis. It is the active ingredient in many skin products for the treatment of acne since it causes skin cells to slough off more readily, preventing them from clogging up the pores.

Salicylic acid belongs to the group of medicines known as keratolytics. Salicylic acid works by breaking down keratin, a protein, which forms part of the skin structure. This results in the shedding of skin cells from the affected area. In the treatment of warts, calluses and verrucae the effect of salicylic acid is to remove the affected skin over a period of time. If successful, the new skin, which grows underneath will be healthy.

One way to increase the productive capacity of biosynthesis is to apply recombinant DNA technology. Thus, it would be desirable to produce salicylic acid and/or salicylic acid esters in plants. That type of production permits control over quality, quantity and selection of the most suitable and efficient producer organisms. The latter is especially important for commercial production economics and therefore availability to consumers. In addition it is desirable to produce salicylic acid in plants in order to increase plant productivity and resistance against biotic and abiotic stress as discussed before.

Methods of recombinant DNA technology have been used for some years to improve the production of fine chemicals in microorganisms and plants by amplifying individual biosynthesis genes and investigating the effect on production of fine chemicals. It is for example reported, that the xanthophyll astaxanthin could be produced in the nectaries of transgenic tobacco plants. Those transgenic plants were prepared by Argobacterium tumifaciens-mediated transformation of tobacco plants using a vector that contained a ketolase-encoding gene from H. pluvialis denominated crtO along with the Pds gene from tomato as the promoter and to encode a leader sequence. Those results indicated that about 75 percent of the carotenoids found in the flower of the transformed plant contained a keto group.

Thus, it would be advantageous if algae, plant or other microorganism were available which produce large amounts of salicylic acid. The invention discussed hereinafter relates in some embodiments to such transformed prokaryotic or eukaryotic microorganisms.

It would also be advantageous if plants were available whose roots, leaves, stems, fruits, seeds or flowers produced large amounts of salicylic acid. The invention discussed hereinafter relates in some embodiments to such transformed plants.

Therefore improving the quality of foodstuffs and animal feeds is an important task of the food-and-feed industry. This is necessary since, for example, salicylic acid, which occur in plants and some microorganisms are limited with regard to the supply of mammals. Especially advantageous for the quality of foodstuffs and animal feeds is as balanced as possible a specific salicylic acid profile in the diet in order to avoid side effects.

To ensure a high quality of foods and animal feeds, it is therefore necessary to add salicylic acid in a balanced manner to suit the organism.

Accordingly, there is still a great demand for new and more suitable genes which encode proteins which participate in the biosynthesis of salicylic acid and/or salicylic acid esters and make it possible to produce certain salicylic acid and/or salicylic acid esters specifically on an industrial scale without unwanted byproducts forming. In the selection of genes for or regulators of biosynthesis two characteristics above all are particularly important. On the one hand, there is as ever a need for improved processes for obtaining the highest possible contents of salicylic acid and/or salicylic acid esters on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is salicylic acid and/or salicylic acid esters. Accordingly, in the present invention, the term "the fine chemical" as used herein relates to "salicylic acid" and/or "salicylic acid esters". Further, the term "the fine chemicals" as used herein also relates to fine chemicals comprising salicylic acid.

In one embodiment, the term "salicylic acid" or "the fine chemical" or "the respective fine chemical" means at least one chemical compound with salicylic acid activity.

An increased salicylic acid content normally means an increased total salicylic acid content. However, an increased salicylic acid content also means, in particular, a modified content of the of a salicylic acid esters, without the need for an inevitable increase in the total salicylic acid content. In a preferred embodiment, the term "the fine chemical" means salicylic acid in free form or its salts or its ester or bound.

Accordingly, the present invention relates to a process for the production of salicylic acid, which comprises (a) increasing or generating the activity of a protein as shown in table II, application no. 24, column 3 encoded by the nucleic acid sequences as shown in table I, application no. 24, column 5, in an organelle of a microorganism or plant, or (b) increasing or generating the activity of a protein as shown in table II, application no. 24, column 3 encoded by the nucleic acid sequences as shown in table I, application no. 24, column 5 in the plastid of a microorganism or plant, or in one or more parts thereof; and (c) growing the organism under conditions which permit the production of the fine chemical, thus, salicylic acid or fine chemicals comprising salicylic acid, in said organism or in the culture medium surrounding the organism.

Accordingly, the term "the fine chemical" means in one embodiment "salicylic acid" in relation to all sequences listed in Table I to IV, application number 24 or homologs thereof.

In another embodiment the present invention is related to a process for the production of salicylic acid, which comprises (a) increasing or generating the activity of a protein as shown in table II, application no. 24 column 3 encoded by the nucleic acid sequences as shown in table I, application no. 24, column 5, in an organelle of a non-human organism, or (b) increasing or generating the activity of a protein as shown in table II, application no. 24, column 3 encoded by the nucleic acid sequences as shown in table I, application no. 24, column 5, which are joined to a nucleic acid sequence encoding a transit peptide in a non-human organism, or in one or more parts thereof; or (c) increasing or generating the activity of a protein as shown in table II, application no. 24, column 3 encoded by the nucleic acid sequences as shown in table I, application no. 24, column 5, which are joined to a nucleic acid sequence encoding chloroplast localization sequence, in a non-human organism, or in one or more parts thereof, and (d) growing the organism under conditions which permit the production of salicylic acid in said organism.

In another embodiment, the present invention relates to a process for the production of salicylic acid, which comprises (a) increasing or generating the activity of a protein as shown in table II, application no. 24, column 3 encoded by the nucleic acid sequences as shown in table I, application no. 24, column 5, in an organelle of a microorganism or plant through the transformation of the organelle, or (b) increasing or generating the activity of a protein as shown in table II, application no. 24, column 3 encoded by the nucleic acid sequences as shown in table I, application no. 24, column 5 in the plastid of a microorganism or plant, or in one or more parts thereof through the transformation of the plastids; and (c) growing the organism under conditions which permit the production of the fine chemical, thus, salicylic acid or fine chemicals comprising salicylic acid, in said organism or in the culture medium surrounding the organism.

Advantageously the activity of the protein as shown in table II, application no. 24, column 3 encoded by the nucleic acid sequences as shown in table I, application no. 24, column 5 is increased or generated in the abovementioned process in the plastid of a microorganism or plant.

for the disclosure of the paragraphs [0019.0.0.23] to [0024.0.0.23] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 24, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 24, column 3 and its homologs as disclosed in table I, application no. 24, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 24, column 3 and its homologs as disclosed in table I, application no. 24, columns 5 and 7.

for the disclosure of the paragraphs [0027.0.0.23] to [0029.0.0.23] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 24, columns 5 and 7. The person skilled in the art is able to join said sequences in a functional manner. Advantageously the transit peptide part is cleaved off from the protein part shown in table II, application no. 24, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 24, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 24, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 24, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 24, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 24, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.23] and [0030.3.0.23] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 24, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, application no. 24, columns 5 and 7 or a sequence encoding a protein, as depicted in table II, application no. 24, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table, 1, application no. 24, columns 5 and 7 or a sequence encoding a protein, as depicted in table II, application no. 24, columns 5 and 7 in such a manner that the viroid sequence transports a sequence transcribed from a sequence as depicted in table I application no. 24, columns 5 and 7 or a sequence encoding a protein as depicted in table II, application no. 24, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 24, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 24, columns 5 and 7.

In a preferred embodiment of the invention the nucleic acid sequences as shown in table I, application no. 24, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 24, columns 5 and 7 are introduced into an expression cassette using a preferably a promoter and terminater, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.23] and [0032.0.0.23] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 24, column 3. Preferably the modification of the activity of a protein as shown in table II, application no. 24, column 3 or their combination can be achieved by joining the protein to a transit peptide.

Surprisingly it was found, that the transgenic expression of the *E. coli* proteins shown in table II, application no. 24, column 3 in plastids of a plant such as *Arabidopsis thaliana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *E. coli* protein b1704, b2040, b3337, b3616 and/or b4039 and/or of the *Saccaromyces cerevisiae* protein YLL033W in *Arabidopsis thaliana* conferred an increase in the salicylic acid content. For example, in one embodiment the level of salicylic acid and/or salicylic acid esters is increased in combination with the modulation of the expression of other genes of the biosynthesis of salicylic acid and/or salicylic acid esters, in particular of genes of the cinnamate and/or chorismate biosynthetic pathway.

for the disclosure of this paragraph see paragraph [0035.0.0.0] above.

The sequence of b1704 (Accession numberNP_416219) from *Escherichia coli* has been published in Blattner et al., Science 277 (5331), 1453-1474 (1997), and its activity is being defined as "3-deoxy-D-arabinoheptulosonate-7-phosphate synthase (DAHP synthetase), tryptophanrepressible". Accordingly, in one embodiment, the process of the present invention comprises the use of a "3-deoxy-D-arabinoheptulosonate-7-phosphate synthase (DAHP synthetase), tryptophanrepressible" or its homolog, e.g. as shown herein, for the production of the fine chemical, meaning of salicylic acid, in particular for increasing the amount of salicylic acid in free or bound form in an organism or a part thereof, as mentioned. In one embodiment, in the process of the present invention the activity of a b1704 protein is increased or generated, e.g. from Escherichia coli or a homolog thereof, preferably linked at least to one transit peptide as mentioned for example in table V.

In another embodiment, in the process of the present invention the activity of a b1704 protein is increased or generated in a subcellular compartment of the organism or organism cell such as in an organelle like a plastid or mitochondria.

The sequence of b2040 (Accession number G64969) from Escherichia coli has been published in Blattner et al., Science 277 (5331), 1453-1474 (1997), and its activity is being defined as "TDP-rhamnose synthase, NAD(P)-binding". Accordingly, in one embodiment, the process of the present invention comprises the use of a "TDP-rhamnose synthase, NAD(P)-binding" or its homolog, e.g. as shown herein, for the production of the fine chemical, meaning of salicylic acid, in particular for increasing the amount of salicylic acid in free or bound form in an organism or a part thereof, as mentioned. In one embodiment, in the process of the present invention the activity of a b2040 protein is increased or generated, e.g. from Escherichia coli or a homolog thereof, preferably linked at least to one transit peptide as mentioned for example in table V.

In another embodiment, in the process of the present invention the activity of a b2040 protein is increased or generated in a subcellular compartment of the organism or organism cell such as in an organelle like a plastid or mitochondria.

The sequence of b3337 (Accession number QQECBB7) from Escherichia coli has been published in Blattner et al., Science 277 (5331), 1453-1474 (1997), and its activity is being defined as "yheA protein". Accordingly, in one embodiment, the process of the present invention comprises the use of a "yheA protein" or its homolog, e.g. as shown herein, for the production of the fine chemical, meaning of salicylic acid, in particular for increasing the amount of salicylic acid in free or bound form in an organism or a part thereof, as mentioned. In one embodiment, in the process of the present invention the activity of a b3337 protein is increased or generated, e.g. from Escherichia coli or a homolog thereof, preferably linked at least to one transit peptide as mentioned for example in table V.

In another embodiment, in the process of the present invention the activity of a b3337 protein is increased or generated in a subcellular compartment of the organism or organism cell such as in an organelle like a plastid or mitochondria.

The sequence of b3616 (Accession number NP_418073) from Escherichia coli has been published in Blattner et al., Science 277 (5331), 1453-1474 (1997), and its activity is being defined as "threonine 3-dehydrogenase, NAD(P)-binding". Accordingly, in one embodiment, the process of the present invention comprises the use of a "threonine 3-dehydrogenase, NAD(P)-binding" or its homolog, e.g. as shown herein, for the production of the fine chemical, meaning of salicylic acid, in particular for increasing the amount of salicylic acid in free or bound form in an organism or a part thereof, as mentioned. In one embodiment, in the process of the present invention the activity of a b3616 protein is increased or generated, e.g. from Escherichia coli or a homolog thereof, preferably linked at least to one transit peptide as mentioned for example in table V.

In another embodiment, in the process of the present invention the activity of a b3616 protein is increased or generated in a subcellular compartment of the organism or organism cell such as in an organelle like a plastid or mitochondria.

The sequence of b4039 (Accession number S25660) from Escherichia coli has been published in Blattner et al., Science 277 (5331), 1453-1474 (1997), and its activity is being defined as "4-hydroxybenzoate synthetase". Accordingly, in one embodiment, the process of the present invention comprises the use of a "4-hydroxybenzoate synthetase" or its homolog, e.g. as shown herein, for the production of the fine chemical, meaning of salicylic acid, in particular for increasing the amount of salicylic acid in free or bound form in an organism or a part thereof, as mentioned. In one embodiment, in the process of the present invention the activity of a b4039 protein is increased or generated, e.g. from Escherichia coli or a homolog thereof, preferably linked at least to one transit peptide as mentioned for example in table V.

In another embodiment, in the process of the present invention the activity of a b4039 protein is increased or generated in a subcellular compartment of the organism or organism cell such as in an organelle like a plastid or mitochondria.

The sequence of YLL033W (Accession number S64784) from Saccharomyces cerevisiae has been published in Goffeau et al., Science 274 (5287), 546-547, 1996, and its activity is being defined as "uncharacterized protein". Accordingly, in one embodiment, the process of the present invention comprises the use of a "uncharacterized protein" or its homolog, e.g. as shown herein, for the production of the fine chemical, meaning of salicylic acid, in particular for increasing the amount of salicylic acid in free or bound form in an organism or a part thereof, as mentioned. In one embodiment, in the process of the present invention the activity of a YLL033W protein is increased or generated, e.g. from Saccharomyces cerevisiae or a homolog thereof, preferably linked at least to one transit peptide as mentioned for example in table V.

In another embodiment, in the process of the present invention the activity of an YLL033W protein is increased or generated in a subcellular compartment of the organism or organism cell such as in an organelle like a plastid or mitochondria.

In one embodiment, the homolog of the YLL033W protein, is a homolog having said activity and being derived from Eukaryot. In one embodiment, the homolog of the b1704, b2040, b3337, b3616 and/or b4039 protein is a homolog having said activity and being derived from bacteria. In one embodiment, the homolog of the YLL033W is a homolog having said activity and being derived from Fungi. In one embodiment, the homolog of the b1704, b2040, b3337, b3616 and/or b4039 is a homolog having said activity and being derived from Proteobacteria. In one embodiment, the homolog of the YLL033W is a homolog having said activity and being derived from Ascomycota. In one embodiment, the homolog of the b1704, b2040, b3337, b3616 and/or b4039 is a homolog having said activity and being derived from Gammaproteobacteria. In one embodiment, the homolog of the YLL033W is a homolog having said activity and being derived from Saccharomycotina. In one embodiment, the homolog of the b1704, b2040, b3337, b3616 and/or b4039 is a homolog having said activity and being derived from Enterobacteriales. In one embodiment, the homolog of the YLL033W is a homolog having said activity and being derived from Saccharomycetes. In one embodiment, the homolog of the b1704, b2040, b3337, b3616 and/or b4039 is a homolog having said activity and being derived from Enterobacteriaceae. In one embodiment, the homolog of the YLL033W is a homolog having said activity and being derived from *Saccharomycetales*. In one embodiment, the homolog of the b1704, b2040, b3337, b3616 and/or b4039 is a homolog having said activity and being derived from *Escherichia*, preferably from *Escherichia coli*. In one embodiment, the homolog of the YLL033W is a homolog having said activity and being derived from Saccharomycetaceae. In one embodiment, the homolog of the YLL033W is a homolog having said activity and being derived from *Saccharomycetes*, preferably from *Saccharomyces cerevisiae*.

Homologs of the polypeptide table II, application no. 24, column 3 may be the polypeptides encoded by the nucleic acid molecules indicated in table I, application no. 24, column 7, resp., or may be the polypeptides indicated in table II, application no. 24, column 7, resp.

for the disclosure of this paragraph see paragraph [0038.0.0.0] above.

In accordance with the invention, a protein or polypeptide has the "activity of an protein as shown in table II, application no. 24, column 3" if its de novo activity, or its increased expression directly or indirectly leads to an increased in the level of the fine chemical indicated in the respective line of table II, application no. 24, column 6 "metabolite" in the organism or a part thereof, preferably in a cell of said organism, more preferably in an organelle such as a plastid or mitochondria of said organism. The protein has the above mentioned activities of a protein as shown in table II, application no. 24, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 24, column 3, or which has at least 10% of the original enzymatic activity, preferably 20%, particularly preferably 30%, most particularly preferably 40% in comparison to a protein as shown in the respective line of table II, application no. 24, column 3.

for the disclosure of the paragraphs [0040.0.0.23] to [0047.0.0.23] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 24, column 3 its biochemical or genetical causes and the increased amount of the respective fine chemical.

for the disclosure of the paragraphs [0049.0.0.23] to [0051.0.0.23] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 24, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.23] to [0058.0.0.23] see paragraphs [0053.0.0.0] to [0058.0.0.0] above.

In case the activity of the *Escherichia coli* protein b1704 or its homologs, e.g. a "3-deoxy-D-arabinoheptulosonate-7-phosphate synthase (DAHP synthetase), tryptophanrepressible" is increased advantageously in an organelle such as a plastid or mitochondria, preferably, in one embodiment an increase of the fine chemical, preferably of salicylic acid between 25% and 266% or more is conferred.

In case the activity of the *Escherichia coli* protein b2040 or its homologs, e.g. a "TDP-rhamnose synthetase, NAD(P)-binding" is increased advantageously in an organelle such as a plastid or mitochondria, preferably, in one embodiment an increase of the fine chemical, preferably of salicylic acid between 41% and 81% or more is conferred. In case the activity of the *Escherichia coli* protein b3337 or its homologs, e.g. a "yheA protein" is increased advantageously in an organelle such as a plastid or mitochondria, preferably, in one embodiment an increase of the fine chemical, preferably of salicylic acid between 73% and 104% or more is conferred.

In case the activity of the *Escherichia coli* protein b3616 or its homologs, e.g. a "threonine 3-dehydrogenase, NAD (P)-binding" is increased advantageously in an organelle such as a plastid or mitochondria, preferably, in one embodiment an increase of the fine chemical, preferably of salicylic acid between 49% and 75% or more is conferred.

In case the activity of the *Escherichia coli* protein b4039 or its homologs, e.g. a "4-hydroxybenzoate synthetase" is increased advantageously in an organelle such as a plastid or mitochondria, preferably, in one embodiment an increase of the fine chemical, preferably of salicylic acid between 44% and 173% or more is conferred.

In case the activity of the *Escherichia coli* protein YLL033W or its homologs, e.g. a "uncharacterized protein" is increased advantageously in an organelle such as a plastid or mitochondria, preferably, in one embodiment an increase of the fine chemical, preferably of salicylic acid between 40% and 59% or more is conferred.

In one embodiment, the activity of any on of the *Escherichia coli* proteins b1704, b2040, b3337, b3616 and/or b4039 and/or of the *Saccaromyces cerevisiae* protein YLL033W for their homologs, is advantageously increased in an organelle such as a plastid or mitochondria, preferably conferring an increase of the fine chemical indicated in column 6 "metabolites" for application no. 24 in any one of Tables I to IV, resp., for the disclosure of the paragraphs [0061.0.0.23] and [0062.0.0.23] see paragraphs [0061.0.0.0] and [0062.0.0.0] above.

A protein having an activity conferring an increase in the amount or level of the fine chemical, preferably upon targeting to the plastids, has in one embodiment the structure of the polypeptide described herein, in particular of the polypeptides comprising the consensus sequence shown in table IV, application no. 24, column 7 or of the polypeptide as shown in the amino acid sequences as disclosed in table II, application no. 24, columns 5 and 7 or the functional homologues thereof as described herein, or is encoded by the nucleic acid molecule characterized herein or the nucleic acid molecule according to the invention, for example by the nucleic acid molecule as shown in table I, application no. 24, columns 5 and 7 or its herein described functional homologues and has the herein mentioned activity.

For the purposes of the present invention, the reference to the fine chemical, e.g. to the term "salicylic acid", also encompasses the corresponding salts, such as, for example, the potassium or sodium salts or the salts with amines and/salicylic acid esters, e.g. but not limited to the methyl ester, the phenyl ester or the menthol ester.

for the disclosure of the paragraphs [0065.0.0.23] and [0066.0.0.23] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 24, columns 5 and 7 or its homologs activity having herein-mentioned salicylic acid increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 24, columns 5 and 7, e.g. a nucleic acid sequence encoding a polypeptide having the activity of a protein as indicated in table II, application no. 24, columns 5 and 7 or its homologs activity or of a mRNA encoding the polypeptide of the present invention having herein-mentioned salicylic acid increasing activity; and/or c) increasing the specific activity of a protein conferring the increased expression of a protein encoded by the nucleic acid molecule of the invention or of the polypeptide of the present invention having herein-mentioned salicylic acid increasing activity, e.g. of a polypeptide having the activity of a protein as indicated in table II, application no. 24, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned salicylic acid increasing activity, e.g. of a polypeptide having the activity of a protein as indicated in table II, application no. 24, columns 5 and 7 or its homologs activity; and/or e) stimulating activity of a protein conferring the increased expression of a protein encoded by the nucleic acid molecule of the present invention or a polypeptide of the present invention having herein-mentioned salicylic acid increasing activity, e.g. of a polypeptide having the activity of a protein as indicated in table II, application no. 24, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned salicylic acid increasing activity, e.g. of a polypeptide having the activity of a protein as indicated in table II, application no. 24, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned salicylic acid increasing activity, e.g. of a polypeptide having the activity of a protein as indicated in table II, application no. 24, columns 5 and 7 or its homologs activity; and/or h) increasing the expression of the endogenous gene encoding the polypeptide of the invention, e.g. a polypeptide having the activity of a protein as indicated in table II, application no. 24, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned salicylic acid increasing activity, e.g. of polypeptide having the activity of a protein as indicated in table II, application no. 24, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned salicylic acid increasing activity, e.g. of a polypeptide having the activity of a protein as indicated in table II, application no. 24, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned salicylic acid increasing activity, e.g. of a polypeptide having the activity of a protein as indicated in table II, application no. 24, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the respective fine chemical as indicated in column 6 of application no. 24 in Table I to IV, resp., after increasing the expression or activity of the encoded polypeptide preferably in organelles such as plastids or having the activity of a polypeptide having an activity as the protein as shown in table II, application no. 24, column 3 or its homologs. Preferably the increase of the fine chemical takes place in plastids.

for the disclosure of the paragraphs [0069.0.0.23] to [0079.0.0.23] see paragraphs [0069.0.0.0] to [0079.0.0.0] above.

The activation of an endogenous polypeptide having above-mentioned activity, e.g. having the activity of a protein as shown in table II, application no. 24, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 24, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 24, column 3. The expression of the chimeric transcription factor in a organism, in particular in a plant, leads to a specific expression of the protein as shown in table II, application no. 24, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.23] to [0084.0.0.23] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous salicylic acid, composition comprising a higher content of (from a viewpoint of nutritional physiology limited) salicylic acid and/or the above mentioned salts and/or esters.

for the disclosure of this paragraph see paragraph [0086.0.0.0] above.

By influencing the metabolism thus, it is possible to produce, in the process according to the invention, further advantageous compounds. Examples of such compounds are salicylic acid salt and/or esters, cinnamate, coumarate, chorismate and/or phenylpyruvate.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 24, column 3 or of a polypeptide being encoded by the nucleic acid molecule of the present invention and described below, e.g. conferring an increase of the respective fine chemical as indicated in any one of Tables I to IV, application no. 24, column 6 "metabolite" in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and
d) if desired, recovering, optionally isolating, the respective free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the respective fine chemical but as option it is also possible to produce, recover and, if desired isolate, other free or/and bound salicylic acid salt and/or esters, cinnamate, coumarate, chorismate and/or phenylpyruvate.

for the disclosure of the paragraphs [0090.0.0.23] to [0097.0.0.23] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 24, columns 5 and 7 or a derivative thereof, or
b) a genetic regulatory element, for example a promoter, which is functionally linked to the nucleic acid sequence as shown table I, application no. 24, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 24, columns 5 and 7 joined to a nucleic acid sequence encoding a transit peptide, or a targeting nucleic acid sequence which directs the nucleic acid sequences disclosed in table I, application no. 24, columns 5 and 7 to the organelle preferentially the plastids. Alternatively the inventive nucleic acids sequences consist advantageously of the nucleic acid sequences as depicted in the sequence protocol and disclosed in table I, application no. 24, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose salicylic acid content is modified advantageously owing to the nucleic acid molecule of the present invention expressed, hence it enhance plant disease resistance. Further, An increased content in salicylic acid or its salts or esters in plants is important because of the multiple use of these compounds as food flavorings and preservatives; antiseptic, anti-infectives, antipyretic, antipyretic, analgesic, fungicidal, keratinolytic and antipyretic agent and as pharmaceutically active ingredients including against colds, flu, or other virus infections, which can be achieved by working up the genetically modified plants.

After the activity of the protein as shown in table II, application no. 24, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.23] to [0110.0.0.23] see paragraphs [0102.0.0.0] to [0110.0.0.0] above.

In a preferred embodiment, the respective fine chemical as indicated in any one of Tables I to IV, application no. 24, column 6 "metabolite" (salicylic acid) is produced in accordance with the invention and, if desired, is isolated. The production of further salts or esters of salicylic acid or mixtures thereof or mixtures with other compounds by the process according to the invention is advantageous.

Thus, the content of plant components and preferably also further impurities is as low as possible, and the abovementioned fine chemicals are obtained in as pure form as possible. In these applications, the content of plant components advantageously amounts to less than 10%, preferably 1%, more preferably 0.1%, very especially preferably 0.01% or less.

In another preferred embodiment of the invention a combination of the increased expression of the nucleic acid sequence or the protein of the invention together with the transformation of a protein or polypeptide or a compound, which functions as a sink for the desired fine chemical, for example salicylic acid in the organism, is useful to increase the production of the respective fine chemical.

In the case of the fermentation of microorganisms, the abovementioned salicylic acid may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, spray granulation or by other methods. Preferably the the respective fine chemical or the salicylic acid comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the salicylic acid and/or salicylic acid esters synthesized in the process according to the invention can advantageously be marketed directly without there being any need for salicylic acid and/or salicylic acid esters synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue. However, the respective fine chemical produced in the process according to the invention can also be isolated from the organisms, advantageously plants, in the form of their oils, fats, lipids as extracts, e.g. ether, alcohol, or other organic solvents or water containing extract and/or free salicylic acid and/or salicylic acid esters. The respective fine chemical produced by this process can be obtained by harvesting the organisms, either from the crop in which they grow, or from the field. This can be done via pressing or extraction of the plant parts, preferably the plant seeds. To increase the efficiency of oil extraction it is beneficial to clean, to temper and if necessary to hull and to flake the plant material especially the seeds. e.g. the oils, fats, lipids, extracts, e.g. ether, alcohol, or other organic solvents or water containing extract and/or free salicylic acid and/or salicylic acid esters can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as preferably warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid.

Salicylic acid and/or salicylic acid esters can for example be analyzed advantageously via HPLC, LC or GC separation and MS (masspectrometry) detection methods. The unambiguous detection for the presence of salicylic acid and/or salicylic acid containing products can be obtained by analyzing recombinant organisms using analytical standard methods: LC, LC-MS, MS or TLC). The material to be analyzed can be disrupted by sonication, grinding in a glass mill, liquid nitrogen and grinding, cooking, or via other applicable methods.

In a preferred embodiment, the present invention relates to a process for the production of the respective fine chemical comprising or generating in an organism or a part thereof, preferably in a cell compartment such as a plastid or mitochondria, the expression of at least one nucleic acid molecule comprising a nucleic acid molecule selected from the group consisting of:
a) nucleic acid molecule encoding, preferably at least the mature form, of the polypeptide shown in table II, application no. 24, columns 5 and 7 or a fragment thereof, which confers an increase in the amount of the respective fine chemical in an organism or a part thereof;
b) nucleic acid molecule comprising, preferably at least the mature form, of the nucleic acid molecule shown in table I, application no. 24, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;
e) nucleic acid molecule which hybridizes with a nucleic acid molecule of (a) to (c) under stringent hybridisation conditions and conferring an increase in the amount of the respective fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;
h) nucleic acid molecule comprising a nucleic acid molecule which is obtained by amplifying nucleic acid molecules from a cDNA library or a genomic library using the primers shown in table III, application no. 24, column 7 and conferring an increase in the amount of the respective fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;
j) nucleic acid molecule which encodes a polypeptide comprising the consensus sequence shown in table IV, application no. 24, column 7 and conferring an increase in the amount of the respective fine chemical in an organism or a part thereof;
k) nucleic acid molecule comprising one or more of the nucleic acid molecule encoding the amino acid sequence of a polypeptide encoding a domain of the polypeptide shown in table II, application no. 24, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in table IA, application no. 24, columns 5 and 7 by one or more nucleotides. In one embodiment, the nucleic acid molecule used in the process of the invention does not consist of the sequence indicated in table IA, application no. 24, columns 5 and 7. In one embodiment, the nucleic acid molecule used in the process of the invention is less than 100%, 99.999%, 99.99%, 99.9% or 99% identical to a sequence indicated in table IA, application no. 24, columns 5 and 7. In another embodiment, the nucleic acid molecule does not encode a polypeptide of a sequence indicated in table IIA, application no. 24, columns 5 and 7.

In one embodiment, the nucleic acid molecule used in the process of the invention distinguishes over the sequence indicated in table IB, application no. 24, columns 5 and 7, by one or more nucleotides. In one embodiment, the nucleic acid molecule used in the process of the invention does not consist of the sequence indicated in table IB, application no. 24, columns 5 and 7. In one embodiment, the nucleic acid molecule used in the process of the invention is less than 100%, 99.999%, 99.99%, 99.9% or 99% identical to a sequence indicated in table IB, application no. 24, columns 5 and 7. In another embodiment, the nucleic acid molecule does not encode a polypeptide of a sequence indicated in table IIB, application no. 24, columns 5 and 7.

In one embodiment, the nucleic acid molecule used in the process distinguishes over the sequence shown in table I, application no. 24, columns 5 and 7 by one or more nucleotides or does not consist of the sequence shown in table I, application no. 24, columns 5 and 7. In one embodiment, the nucleic acid molecule of the present invention is less than 100%, 99.999%, 99.99%, 99.9% or 99% identical to the sequence shown in table I, application no. 24, columns 5 and 7. In another embodiment, the nucleic acid molecule does not encode a polypeptide of the sequence shown in table II, application no. 24, columns 5 and 7.

for the disclosure of the paragraphs [0118.0.0.23] to [0120.0.0.23] see paragraphs [0118.0.0.0] to [0120.0.0.0] above.

The expression of nucleic acid molecules with the sequence shown in table I, application no. 24, columns 5 and 7, or nucleic acid molecules which are derived from the amino acid sequences shown in table II, application no. 24, columns 5 and 7 or from polypeptides comprising the consensus sequence shown in table IV, application no. 24, column 7, or their derivatives or homologues encoding polypeptides with the enzymatic or biological activity of a protein as shown in table II, application no. 24, column 3, and conferring an increase of the respective fine chemical (column 6 of application no. 24 in any one of Tables I to IV) after increasing its plastidic and/or specific activity in the plastids is advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 24, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 24, column 3 and which confer an increase in the level of the respective fine chemical indicated in table II, application no. 24, column 6 by being expressed either in the cytsol or in an organelle such as a plastid or mitochondria or both, preferably in plastids, and the gene product being localized in the plastid and other parts of the cell or in the plastid as described above.

for the disclosure of the paragraphs [0126.0.0.23] to [0133.0.0.23] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 24, columns 5 and 7 or the functional homologues thereof as described herein, preferably conferring above-mentioned activity, i.e. conferring an increase of the respective fine chemical after increasing its plastidic activity, e.g. after increasing the activity of a protein as shown in table II, application no. 24, column 3 by—for example—expression either in the cytsol or in an organelle such as a plastid or mitochondria or both, preferably in plastids and the gene product, e.g. the polypeptide, being localized in the plastid and other parts of the cell or in the plastid as described above.

for the disclosure of the paragraphs [0135.0.0.23] to [0140.0.0.23] see paragraphs [0135.0.0.0] to [0140.0.0.0] above.

Synthetic oligonucleotide primers for the amplification, e.g. as shown in table III, application no. 24, column 7, by means of polymerase chain reaction can be generated on the basis of a sequence shown herein, for example the sequence shown in table I, application no. 24, columns 5 and 7 or the sequences derived from table II, application no. 24, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 24, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 24, column 3 or further functional homologs of the polypeptide of the invention from other organisms.

for the disclosure of the paragraphs [0144.0.0.23] to [0151.0.0.23] see paragraphs [0144.0.0.0] to [0151.0.0.0] above.

Polypeptides having above-mentioned activity, i.e. conferring the increase of the respective fine chemical indicated in table I, application no. 24, column 6, and being derived from other organisms, can be encoded by other DNA sequences which hybridize to the sequences shown in table I, application no. 24, columns 5 and 7, preferably of table IB, application no. 24, columns 5 and 7 under relaxed hybridization conditions and which code on expression for peptides having the respective fine chemical, i.e. salicylic acid resp., in particular, of salicylic acid increasing activity.

for the disclosure of the paragraphs [0153.0.0.23] to [0159.0.0.23] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 24, columns 5 and 7, preferably shown in table IB, application no. 24, columns 5 and 7 is one which is sufficiently complementary to one of the nucleotide sequences shown in table I, application no. 24, columns 5 and 7, preferably shown in table IB, application no. 24, columns 5 and 7 such that it can hybridize to one of the nucleotide sequences shown in table I, application no. 24, columns 5 and 7, preferably shown in table IB, application no. 24, columns 5 and 7, thereby forming a stable duplex. Preferably, the hybridisation is performed under stringent hybrization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 24, columns 5 and 7, preferably shown in table IB, application no. 24, columns 5 and 7, or a portion thereof and preferably has above mentioned activity, in particular having a respective fine chemical increasing activity after increasing the activity or an activity of a gene product as shown in table II, application no. 24, column 3 by for example expression either in the cytsol or in an organelle such as a plastid or mitochondria or both, preferably in plastids, and the gene product, e.g. the polypeptide, being localized in the plastid and other parts of the cell or in the plastid as described above.

The nucleic acid molecule of the invention comprises a nucleotide sequence which hybridizes, preferably hybridizes under stringent conditions as defined herein, to one of the nucleotide sequences shown in table I, application no. 24, columns 5 and 7, preferably shown in table IB, application no. 24, columns 5 and 7, or a portion thereof and encodes a protein having above-mentioned activity, e.g. conferring of a salicylic acid and/or salicylic acid esters increase by for example expression either in the cytsol or in an organelle such as a plastid or mitochondria or both, preferably in plastids, and optionally, the activity of a protein as shown in table II, application no. 24, column 3, and the gene product, e.g. the polypeptide, being localized in the plastid and other parts of the cell or in the plastid as described above.

Moreover, the nucleic acid molecule of the invention can comprise only a portion of the coding region of one of the sequences shown in table I, application no. 24, columns 5 and 7, preferably shown in table IB, application no. 24, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the respective fine chemical indicated in Table I, application no. 24, column 6, if its activity is increased by for example expression either in the cytsol or in an organelle such as a plastid or mitochondria or both, preferably in plastids, and the gene product, e.g. the polypeptide, being localized in the plastid and other parts of the cell or in the plastid as described above. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 24, columns 5 and 7, an anti-sense sequence of one of the sequences, e.g., set forth in table I, application no. 24, columns 5 and 7, preferably shown in table IB, application no. 24, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 24, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 24, columns 5 and 7 such that the protein or portion thereof maintains the ability to participate in the fine chemical production, in particular an activity increasing the level of salicylic acid, increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 24, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 24, columns 5 and 7 and having above-mentioned activity, e.g. conferring preferably the increase of the respective fine chemical by for example expression either in the cytsol or in an organelle such as a plastid or mitochondria or both, preferably in plastids, and the gene product, e.g. the polypeptide, being localized in the plastid and other parts of the cell or in the plastid as described above.

for the disclosure of the paragraphs [0168.0.0.23] and [0169.0.0.23] see paragraphs [0168.0.0.0] and [0169.0.0.0] above.

The invention further relates to nucleic acid molecules that differ from one of the nucleotide sequences shown in table I, application no. 24, columns 5 and 7 (and portions thereof due to degeneracy of the genetic code and thus encode a polypeptide of the present invention, in particular a polypeptide having above mentioned activity, e.g. conferring an increase in the respective fine chemical in a organism, e.g. as that polypeptides depicted by the sequence shown in table II, application no. 24, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 24, columns 5 and 7 or the functional homologues. In a still further embodiment, the nucleic acid molecule of the invention encodes a full length protein which is substantially homologous to an amino acid sequence shown in table II, application no. 24, columns 5 and 7 or the functional homologues. However, in a preferred embodiment, the nucleic acid molecule of the present invention does not consist of the sequence shown in table I, application no. 24, columns 5 and 7, preferably as indicated in table IA, application no. 24, columns 5 and 7. Preferably the nucleic acid molecule of the invention is a functional homologue or identical to a nucleic acid molecule indicated in table IB, application no. 24, columns 5 and 7.

for the disclosure of the paragraphs [0171.0.0.23] to [0173.0.0.23] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 24, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 24, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 24, columns 5 and 7.

for the disclosure of the paragraphs [0179.0.0.23] and [0180.0.0.23] see paragraphs [0179.0.0.0] and [0180.0.0.0] above.

Accordingly, the invention relates to nucleic acid molecules encoding a polypeptide having above-mentioned activity, e.g. conferring an increase in the the respective fine chemical in an organisms or parts thereof by for example expression either in the cytsol or in an organelle such as a plastid or mitochondria or both, preferably in plastids (as described), that contain changes in amino acid residues that are not essential for said activity. Such polypeptides differ in amino acid sequence from a sequence contained in the sequences shown in table II, application no. 24, columns 5 and 7, preferably shown in table IIA, application no. 24, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 24, columns 5 and 7, preferably shown in table IIA, application no. 24, columns 5 and 7 and is capable of participation in the increase of production of the fine chemical after increasing its activity, e.g. its expression by for example expression either in the cytsol or in an organelle such as a plastid or mitochondria or both, preferably in plastids and the gene product, e.g. the polypeptide, being localized in the plastid and other parts of the cell or in the plastid as described above. Preferably, the protein encoded by the nucleic acid molecule is at least about 60% identical to the sequence shown in table II, application no. 24, columns 5 and 7, preferably shown in table IIA, application no. 24, columns 5 and 7, more preferably at least about 70% identical to one of the sequences shown in table II, application no. 24, columns 5 and 7, preferably shown in table IIA, application no. 24, columns 5 and 7, even more preferably at least about 80%, 90%, 95% homologous to the sequence shown in table II, application no. 24, columns 5 and 7, preferably shown in table IIA, application no. 24, columns 5 and 7, and most preferably at least about 96%, 97%, 98%, or 99% identical to the sequence shown in table II, application no. 24, columns 5 and 7, preferably shown in table IIA, application no. 24, columns 5 and 7.

for the disclosure of the paragraphs [0182.0.0.23] to [0188.0.0.23] see paragraphs [0182.0.0.0] to [0188.0.0.0] above.

Functional equivalents derived from one of the polypeptides as shown in table II, application no. 24, columns 5 and 7, preferably shown in table IIB, application no. 24, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 24, columns 5 and 7, preferably shown in table IIB, application no. 24, columns 5 and 7 resp., according to the invention and are distinguished by essentially the same properties as the polypeptide as shown in table II, application no. 24, columns 5 and 7, preferably shown in table IIB, application no. 24, columns 5 and 7.

Functional equivalents derived from the nucleic acid sequence as shown in table I, application no. 24, columns 5 and 7, preferably shown in table IB, application no. 24, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 24, columns 5 and 7, preferably shown in table IIB, application no. 24, columns 5 and 7 resp., according to the invention and encode polypeptides having essentially the same properties as the polypeptide as shown in table II, application no. 24, columns 5 and 7, preferably shown in table IIB, application no. 24, columns 5 and 7.

for the disclosure of this paragraph see paragraph [0191.0.0.0] above.

A nucleic acid molecule encoding an homologous to a protein sequence of table II, application no. 24, columns 5 and 7, preferably shown in table IIB, application no. 24, columns 5 and 7 resp., can be created by introducing one or more nucleotide substitutions, additions or deletions into a nucleotide sequence of the nucleic acid molecule of the present invention, in particular of table I, application no. 24, columns 5 and 7, preferably shown in table IB, application no. 24, columns 5 and 7 resp., such that one or more amino acid substitutions, additions or deletions are introduced into the encoded protein. Mutations can be introduced into the encoding sequences of table I, application no. 24, columns 5 and 7, preferably shown in table IB, application no. 24, columns 5 and 7 resp., by standard techniques, such as site-directed mutagenesis and PCR-mediated mutagenesis.

for the disclosure of the paragraphs [0193.0.0.23] to [0196.0.0.23] see paragraphs [0193.0.0.0] to [0196.0.0.0] above.

Homologues of the nucleic acid sequences used, with the sequence shown in table I, application no. 24, columns 5 and 7, preferably shown in table IB, application no. 24, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 24, columns 5 and 7, preferably shown in table IB, application no. 24, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 24, columns 5 and 7, preferably shown in table IB, application no. 24, columns 5 and 7. It is preferred that the nucleic acid molecule comprises as little as possible other nucleotides not shown in any one of table I, application no. 24, columns 5 and 7, preferably shown in table IB, application no. 24, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 24, columns 5 and 7, preferably shown in table IB, application no. 24, columns 5 and 7.

Also preferred is that the nucleic acid molecule used in the process of the invention encodes a polypeptide comprising the sequence shown in table II, application no. 24, columns 5 and 7, preferably shown in table IIB, application no. 24, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 24, columns 5 and 7, preferably shown in table IIB, application no. 24, columns 5 and 7.

In one embodiment, the nucleic acid molecule of the invention or used in the process encodes a polypeptide comprising the sequence shown in table II, application no. 24, columns 5 and 7, preferably shown in table IIB, application no. 24, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 24, columns 5 and 7, preferably shown in table IB, application no. 24, columns 5 and 7.

Polypeptides (=proteins), which still have the essential biological or enzymatic activity of the polypeptide of the present invention conferring an increase of the respective fine chemical indicated in column 6 of Table I, application no. 24, i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 24, columns 5 and 7 expressed under identical conditions.

Homologues of table I, application no. 24, columns 5 and 7 or of the derived sequences of table II, application no. 24, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.23] to [0215.0.0.23] see paragraphs [0203.0.0.0] to [0215.0.0.0] above.

Accordingly, in one embodiment, the invention relates to a nucleic acid molecule, which comprises a nucleic acid molecule selected from the group consisting of:
a) nucleic acid molecule encoding, preferably at least the mature form, of the polypeptide shown in table II, application no. 24, columns 5 and 7, preferably in table IIB, application no. 24, columns 5 and 7; or a fragment thereof conferring an increase in the amount of the fine chemical according to table IIB, application no. 24, column 6 in an organism or a part thereof
b) nucleic acid molecule comprising, preferably at least the mature form, of the nucleic acid molecule shown in table I, application no. 24, columns 5 and 7, preferably in table IB, application no. 24, columns 5 and 7 or a fragment thereof conferring an increase in the amount of the fine chemical according to table IIB, application no. 24, column 6 in an organism or a part thereof;
c) nucleic acid molecule whose sequence can be deduced from a polypeptide sequence encoded by a nucleic acid molecule of (a) or (b) as result of the degeneracy of the genetic code and conferring an increase in the amount of the fine chemical according to table IIB, application no. 24, column 6 in an organism or a part thereof;
d) nucleic acid molecule encoding a polypeptide whose sequence has at least 50% identity with the amino acid sequence of the polypeptide encoded by the nucleic acid molecule of (a) to (c) and conferring an increase in the amount of the fine chemical according to table IIB, application no. 24, column 6 in an organism or a part thereof;
e) nucleic acid molecule which hybridizes with a nucleic acid molecule of (a) to (c) under stringent hybridisation conditions and conferring an increase in the amount of the fine chemical according to table IIB, application no. 24, column 6 in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical according to table IIB, application no. 24, column 6 in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical according to table IIB, application no. 24, column 6 in an organism or a part thereof;
h) nucleic acid molecule comprising a nucleic acid molecule which is obtained by amplifying a cDNA library or a genomic library using the primers in table III, application no. 24, column 7 and conferring an increase in the amount of the fine chemical according to table IIB, application no. 24, column 6 in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising the consensus sequence shown in table IV, application no. 24, column 7 and conferring an increase in the amount of the fine chemical in an organism or a part thereof;
k) nucleic acid molecule encoding the amino acid sequence of a polypeptide encoding a domaine of the polypeptide shown in table II, application no. 24, columns 5 and 7 and conferring an increase in the amount of the fine chemical according to table IIB, application no. 24, column 6 in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I, application no. 24, columns 5 and 7 or a nucleic acid molecule encoding, preferably at least the mature form of, the polypeptide shown in table II, application no. 24, columns 5 and 7, and conferring an increase in the amount of the fine chemical according to table IIB, application no. 24, column 6 in an organism or a part thereof; or which encompasses a sequence which is complementary thereto;

whereby, preferably, the nucleic acid molecule according to (a) to (l) distinguishes over the sequence depicted in table IA and/or IB, application no. 24, columns 5 and 7 by one or more nucleotides. In one embodiment, the nucleic acid molecule of the invention does not consist of the sequence shown in table IA and/or IB, application no. 24, columns 5 and 7. In an other embodiment, the nucleic acid molecule of the present invention is at least 30% identical and less than 100%, 99.999%, 99.99%, 99.9% or 99% identical to the sequence shown in table IA and/or IB, application no. 24, columns 5 and 7. In a further embodiment the nucleic acid molecule does not encode the polypeptide sequence shown in table IIA and/or IIB, application no. 24, columns 5 and 7. Accordingly, in one embodiment, the nucleic acid molecule of the present invention encodes in one embodiment a polypeptide which differs at least in one or more amino acids from the polypeptide shown in table IIA and/or IIB, application no. 24, columns 5 and 7 does not encode a protein of the sequence shown in table IIA and/or IIB, application no. 24, columns 5 and 7. Accordingly, in one embodiment, the protein encoded by a sequence of a nucleic acid accoriding to (a) to (l) does not consist of the sequence shown in table IA and/or IB, application no. 24, columns 5 and 7. In a further embodiment, the protein of the present invention is at least 30% identical to protein sequence depicted in table IIA and/or IIB, application no. 24, columns 5 and 7 and less than 100%, preferably less than 99.999%, 99.99% or 99.9%, more preferably less than 99%, 985, 97%, 96% or 95% identical to the sequence shown in table IIA and/or IIB, application no. 24, columns 5 and 7.

for the disclosure of the paragraphs [0217.0.0.23] to [0226.0.0.23] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 24, columns 5 and 7 can be cloned 3'prime to the transitpeptide encoding sequence, leading to a functional preprotein, which is directed to the plastids and which means that the mature protein fulfills its biological activity.

for the disclosure of the paragraphs [0228.0.0.23] to [0239.0.0.23] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorgansms.

In addition to the sequence mentioned in Table I, application no. 24, columns 5 and 7 or its derivatives, it is advantageous additionally to express and/or mutate further genes in the organisms. Especially advantageously, additionally at least one further gene of the cinnamate and/or chorismate biosynthetic pathway such as for a salicylic acid precursor, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the sequences shown in Table I, application no. 24, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the salicylic acid-metabolism, in particular in synthesis of salicylic acid.

Further advantageous nucleic acid sequences which can be expressed in combination with the sequences used in the process and/or the abovementioned biosynthesis genes are the sequences encoding further genes of the salicylic acid biosynthetic pathway, genes of the glutamic acid metabolism, the phosphoenolpyruvate metabolism, the amino acid metabolism, of glycolysis, of the tricarboxylic acid metabolism or their combinations. These genes can lead to an increased synthesis of the essential salicylic acid resp., in particular, of the fine chemical indicated in column 6, application no. 24 of any one of Tables I to IV.

In a further advantageous embodiment of the process of the invention, the organisms used in the process are those in which simultaneously a salicylic acid degrading protein is attenuated, in particular by reducing the rate of expression of the corresponding gene.

for the disclosure of the paragraph [0242.2.0.23] see paragraph [0242.2.0.9]

for the disclosure of the paragraphs [0243.0.0.23] to [0264.0.0.23] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 24, columns 5 and 7 and described herein to achieve an expression in one of said compartments or extracellular.

for the disclosure of the paragraphs [0266.0.0.23] to [0287.0.0.23] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 24, columns 5 and 7 or their homologs is functionally linked to a plastidial targeting sequence. A further preferred embodiment of the invention relates to a vector in which a nucleic acid sequence encoding one of the polypeptides shown in table II, application no. 2410, columns 5 and 7 or their homologs is functionally linked to a regulatory sequences which permit the expression in plastids.

for the disclosure of the paragraphs [0289.0.0.23] to [0296.0.0.23] see paragraphs [0289.0.0.0] to [0296.0.0.0] above.

Moreover, a native polypeptide conferring the increase of the respective fine chemical in an organism or part thereof can be isolated from cells (e.g., endothelial cells), for example using the antibody of the present invention as described herein, in particular, an antibody against polypeptides as shown in table II, application no. 24, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 24, columns 5 and 7 or as coded by the nucleic acid molecule shown in table I, application no. 24, columns 5 and 7 or functional homologues thereof.

In one advantageous embodiment, in the method of the present invention the activity of a polypeptide is increased comprising or consisting of the consensus sequence shown in table IV, application no. 24, columns 7 and in one another embodiment, the present invention relates to a polypeptide comprising or consisting of the consensus sequence shown in table IV, application no. 24, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.23] to [0304.0.0.23] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 24, columns 5 and 7 by one or more amino acids. In one embodiment, polypeptide distinguishes form the sequence shown in table IIA and/or IIB, application no. 24, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 24, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 24, columns 5 and 7.

for the disclosure of this paragraph see paragraph [0306.0.0.0] above.

In one embodiment, the invention relates to polypeptide conferring an increase of level of the respective fine chemical indicated in Table IIA and/or IIB, application no. 24, column 6 in an organism or part being encoded by the nucleic acid molecule of the invention or used in the process of the invention and having a sequence which distinguishes from the sequence as shown in table IIA and/or IIB, application no. 24, columns 5 and 7 by one or more amino acids. In another embodiment, said polypeptide of the invention does not consist of the sequence shown in table IIA and/or IIB, application no. 24, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 24, columns 5 and 7.

In one embodiment, the present invention relates to a polypeptide having the activity of the protein as shown in table II, application no. 24, column 3, which distinguishes over the sequence depicted in table IIA and/or IIB, application no. 24, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle, for example into the plastid or mitochondria.

for the disclosure of the paragraphs [0309.0.0.23] to [0311.0.0.23] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 24, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 24, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 24, columns 5 and 7 or which is homologous thereto, as defined above.

Accordingly the polypeptide of the present invention can vary from the sequences shown in table IIA and/or IIB, application no. 24, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 24, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 24, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 24, column 3. Differences shall mean at least one amino acid different from the sequences as shown in table II, application no. 24, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 24, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 24, column 3. The nucleic acid molecules and polypeptide molecules of the invention are expressed such that the yield, production, and/or efficiency of production of a desired compound is improved.

Preferably, the compound is a composition comprising the essentially pure fine chemical, i.e. salicylic acid or a recovered or isolated salicylic acid, respectively, e.g. in free or in protein- or membrane-bound form.

for the disclosure of the paragraphs [0320.0.0.23] to [0322.0.0.23] see paragraphs [0320.0.0.0] to [0322.0.0.0] above.

In one embodiment, a protein (=polypeptide) as shown in table II, application no. 24, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 24, column 3, e.g., a protein which does not confer the activity described herein and which is derived from the same or a different organism.

for the disclosure of the paragraphs [0324.0.0.23] to [0329.0.0.23] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 24, columns 5 and 7.

for the disclosure of the paragraphs [0331.0.0.23] to [0346.0.0.23] see paragraphs [0331.0.0.0] to [0346.0.0.0] above.

Accordingly the present invention relates to any cell transgenic for any nucleic acid characterized as part of the invention, e.g. conferring the increase of the respective fine chemical indicated in column 6 of application no. 24 in any one of Tables I to IV in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 24, column 3. Due to the above mentioned activity the respective fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 24, column 3 or a protein as shown in table II, application no. 24, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 24, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.23] to [0358.0.0.23] see paragraphs [0350.0.0.0] to [0358.0.0.0] above.

Transgenic plants comprising the respective fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The respective fine chemical indicated in column 6 of any one of Tables I to IV, application no. 24, e.g. salicylic acid resp., and being produced in the process according to the invention may, however, also be isolated from the plant and can be isolated by harvesting the plants either from the culture in which they grow or from the field. This can be done for example via expressing, grinding and/or extraction of the plant parts, preferably the plant seeds, plant fruits, plant tubers and the like.

for the disclosure of the paragraphs [0360.0.0.23] to [0364.0.0.23] see paragraphs [0360.0.0.0] to [0364.0.0.0] above.

The fine chemical indicated in column 6 of application no. 24 in Table I, in particular salicylic acid resp., and being obtained in the process of the invention are suitable as starting material for the synthesis of further products of value. For example, they can be used in combination with each other or alone for the production of pharmaceuticals, foodstuffs, animal feeds or cosmetics. Accordingly, the present invention relates a method for the production of pharmaceuticals, food stuff, animal feeds, nutrients or cosmetics comprising the steps of the process according to the invention, including the isolation of a composition comprising the fine chemical, e.g. salicylic acid, or the isolated respective fine chemical produced, if desired, and formulating the product with a pharmaceutical acceptable carrier or formulating the product in a form acceptable for an application in agriculture. A further embodiment according to the invention is the use of the respective fine chemical indicated in application no. 24, Table I, column 6, and being produced in the process or the use of the transgenic organisms in animal feeds, foodstuffs, medicines, food supplements, cosmetics or pharmaceuticals.

for the disclosure of the paragraphs [0366.0.0.23] to [0369.0.0.23] see paragraphs [0366.0.0.0] to [0369.0.0.0] above.

The fermentation broths obtained in this way, containing in particular the respective fine chemical indicated in column 6 of any one of Tables I to IV; application no. 24 or containing mixtures with other compounds, in particular with salicylic acid and/or salicylic acid salts and/or salicylic acid esters or containing microorganisms or parts of microorganisms, like plastids, normally have a dry matter content of from 7.5 to 25% by weight. The fermentation broth can be processed further. Depending on requirements, the biomass can be separated, such as, for example, by centrifugation, filtration, decantation coagulation/flocculation or a combination of these methods, from the fermentation broth or left completely in it. The fermentation broth can be thickened or concentrated by known methods, such as, for example, with the aid of a rotary evaporator, thin-film evaporator, falling film evaporator, by reverse osmosis or by nano-filtration. This concentrated fermentation broth can then be worked up by extraction, freeze-drying, spray drying, spray granulation or by other processes.

Accordingly, it is possible to purify the salicylic acid and/or salicylic acid esters produced according to the invention further. For this purpose, the product-containing composition is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.23] to [0376.0.0.23], [0376.1.0.23] and [0377.0.0.23] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:

(a) contacting, e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in table I, application no. 24, columns 5 and 7, preferably in table IB, application no. 24, columns 5 and 7, and, optionally, isolating the full length cDNA clone or complete genomic clone;

(c) introducing the candidate nucleic acid molecules in host cells, preferably in a plant cell or a microorganism, appropriate for producing the respective fine chemical;

(d) expressing the identified nucleic acid molecules in the host cells;

(e) assaying the respective fine chemical level in the host cells; and (f) identifying the nucleic acid molecule and its gene product which expression confers an increase in the respective fine chemical level in the host cell after expression compared to the wild type.

for the disclosure of the paragraphs [0379.0.0.23] to [0383.0.0.23] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 24, column 3, e.g. comparing near identical organisms with low and high activity of the proteins as shown in table II, application no. 24, column 3.

for the disclosure of the paragraphs [0385.0.0.23] to [0404.0.0.23] see paragraphs [0385.0.0.0] to [0404.0.0.0] above.

Accordingly, the nucleic acid of the invention, the polypeptide of the invention, the nucleic acid construct of the invention, the organisms, the host cell, the microorgansms, the plant, plant tissue, plant cell, or the part thereof of the invention, the vector of the invention, the agonist identified with the method of the invention, the nucleic acid molecule identified with the method of the present invention, can be used for the production of the respective fine chemical indicated in Column 6, Table I, application no. 24 or for the production of the respective fine chemical and one or more other carotenoids, vitamins or fatty acids. In one embodiment, in the process of the present invention, the produced salicylic acid is used as food flavorings and preservatives; antiseptic, anti-infectives, antipyretic, antipyretic, analgesic, fungicidal, keratinolytic and antipyretic agent and as pharmaceutically active ingredients including against colds, flu, or other virus infections Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the antibody of the present invention, can be used for the reduction of the respective fine chemical in a organism or part thereof, e.g. in a cell.

for the disclosure of the paragraphs [0406.0.0.23] to [0416.0.0.23] see paragraphs [0406.0.0.0] to [0416.0.0.0] above.

An in vivo mutagenesis of organisms such as algae (e.g. *Spongiococcum* sp, e.g. *Spongiococcum exentricum*, *Chlorella* sp., *Haematococcus*, *Phaedactylum tricornatum*, *Volvox* or *Dunaliella*), *Synechocystis* sp. PCC 6803, *Physcometrella patens*, *Saccharomyces*, *Mortierella*, *Escherichia* and others mentioned above, which are beneficial for the production of salicylic acid can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widly used as chemical agents for random in-vitro mutagenesis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired fine chemical.

for the disclosure of the paragraphs [0418.0.0.9] to [0427.0.0.9] see paragraphs [0418.0.0.0] to [0427.0.0.0] above.

for the disclosure of the paragraphs [0428.0.0.23] to [0435.0.0.23] see paragraphs [0428.0.0.0] to [0435.0.0.0] above.

Salicylic Acid Production

Salicylic acid, can be detected and analysed as mentioned above. The proteins and nucleic acids can be analysed as mentioned below.

and [0438.0.0.923 for the disclosure of the paragraphs [0437.0.0.23] and [0438.0.0.23] see paragraphs [0437.0.0.0] and [0438.0.0.0] above.

Example 8

Analysis of the Effect of the Nucleic Acid Molecule on the Production of the Respective Fine Chemical Indicated in Table I, Application No. 24, Column 6

The effect of the genetic modification in plants, fungi, algae or ciliates on the production of a desired compound can be determined by growing the modified microorganisms or the modified plant under suitable conditions (such as those described above) and analyzing the medium and/or the cellular components for the elevated production of desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications).

for the disclosure of this paragraph see [0441.0.0.0] above.

Example 9

Purification of the Salicylic Acid

Abbreviations: GC-MS, gas liquid chromatography/mass spectrometry; TLC, thin-layer chromatography.

The unambiguous detection for the presence of salicylic acid and/or salts and/or esters of salicylic acidcan be obtained by analyzing recombinant organisms using analytical standard methods: GC, GC-MS or TLC, as described (1997, in: Advances on Lipid Methodology, Fourth Edition: Christie, Oily Press, Dundee, 119-169; 1998, Gaschro-matographie-Massenspektrometrie-Verfahren [Gas chromatography/mass spectrometric methods], Lipide 33:343-353).

The total salicylic acid produced in the organism for example in yeasts used in the inventive process can be analysed for example according to the following procedure: The material such as yeasts, E. coli or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, separation of non-polar epiphase from more polar hypophasic derivatives and chromatography.

Characterization of the Transgenic Plants

In order to confirm that salicylic acid biosynthesis in the transgenic plants is influenced by the expression of the polypeptides described herein, the tocopherol/vitamin E content in leaves and seeds of the plants transformed with the described constructs (*Arabidopsis thaliana*, *Brassica napus* and *Nicotiana tabacum*) is analyzed. For this purpose, the transgenic plants are grown in a greenhouse, and plants which express the gene coding for polypeptide of the invention or used in the method of the invention are identified at the Northern level. The tocopherol content or the vitamin E content in leaves and seeds of these plants is measured. In all, the tocopherol concentration is raised by comparison with untransformed plants.

If required and desired, further chromatography steps with a suitable resin may follow. Advantageously, the salicylic acid, can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

for the disclosure of the paragraphs [0446.0.0.23] to [0496.0.0.23] see paragraphs [0446.0.0.0] to [0496.0.0.0] above.

%

The results of the different plant analyses can be seen from the table, which follows:

TABLE VI

| ORF | Metabolite | Method/Analytics | Min.-Value | Max.-Value |
|---|---|---|---|---|
| b1704 | Salicylic acid | LC | 1.25 | 3.66 |
| b2040 | Salicylic acid | LC | 1.41 | 1.81 |
| b3337 | Salicylic acid | LC | 1.73 | 2.04 |
| b3616 | Salicylic acid | LC | 1.49 | 1.75 |
| b4039 | Salicylic acid | LC | 1.44 | 2.73 |
| YLL033W | Salicylic acid | LC | 1.40 | 1.59 |

In the context of this table "salicylic acid" means the total amount salicylic acid.

for the disclosure of the paragraphs [0499.0.0.23] and [0500.0.0.23] see paragraphs [0499.0.0.0] and [0500.0.0.0] above.

Example 15a

Engineering Ryegrass Plants by Over-Expressing b1704 from *E. coli* or Homologs of b1704 from Other Organisms for the disclosure of the paragraphs [0502.0.0.23] to [0508.0.0.23] see paragraphs [0502.0.0.0] to [0508.0.0.0] above.

Example 15b

Engineering Soybean Plants by Over-Expressing b1704 from *E. coli* or Homologs of b1704 from Other Organisms for the disclosure of the paragraphs [0510.0.0.23] to [0513.0.0.23] see paragraphs [0510.0.0.0] to [0513.0.0.0] above.

Example 15c

Engineering Corn Plants by Over-Expressing b1704 from *E. coli* or Homologs of b1704 from Other Organisms for the disclosure of the paragraphs [0515.0.0.23] to [0540.0.0.23] see paragraphs [0515.0.0.0] to [0540.0.0.0] above.

Example 15d

Engineering Wheat Plants by Over-Expressing b1704 from *E. coli* or Homologs of b1704 from Other Organisms for the disclosure of the paragraphs [0542.0.0.23] to [0544.0.0.23] see paragraphs [0542.0.0.0] to [0544.0.0.0] above.

Example 15e

Engineering Rapeseed/Canola Plants by Over-Expressing b1704 from *E. coli* or Homologs of b1704 from Other Organisms for the disclosure of the paragraphs [0546.0.0.23] to [0549.0.0.23] see paragraphs [0544.0.0.0] to [0549.0.0.0] above.

Example 15f

Engineering Alfalfa Plants by Over-Expressing b1704 from *E. coli* or Homologs of b1704 from Other Organisms for the disclosure of the paragraphs [0551.0.0.23] to [0554.0.0.23] see paragraphs [0551.0.0.0] to [0554.0.0.0] above.
for the disclosure of this paragraph see [0554.2.0.0] above.
for the disclosure of this paragraph see [0555.0.0.0] above.
for the disclosure of this paragraph see [0001.0.0.0].
for the disclosure of the paragraphs [0002.0.24.24] to [0009.0.24.24] see paragraphs [0002.0.10.10] and [0009.0.10.10] above.

Therefore improving the quality of foodstuffs and animal feeds is an important task of the food-and-feed industry. This is necessary since, for example, carotenoids, e.g. beta-carotene or its/their precursor, e.g. isopentyl pyrophosphate (IPP), which occur in plants and some microorganisms are limited with regard to the supply of mammals. Especially advantageous for the quality of foodstuffs and animal feeds is as balanced as possible a cartenoid profile in the diet since a great excess of some carotenoids above a specific concentration in the food has only some or little or no positive effect. A further increase in quality is only possible via addition of further carotenoids, which are limiting.

for the disclosure of the paragraph [0011.0.24.24] see paragraph [0011.0.10.10].

Accordingly, there is still a great demand for new and more suitable genes which encode proteins which participate in the biosynthesis of carotenoids, e.g. beta-carotene or its/their precursor, e.g. isopentyl pyrophosphate (IPP) and make it possible to produce certain carotenoids, e.g. beta-carotene or its/their precursor, e.g. isopentyl pyrophosphate (IPP) specifically on an industrial scale without unwanted by-products forming. In the selection of genes for or regulators of biosynthesis two characteristics above all are particularly important. On the one hand, there is as ever a need for improved processes for obtaining the highest possible contents of carotenoids, like beta-carotene or its/their precursor, like isopentyl pyrophosphate (IPP) on the other hand as less as possible byproducts should be produced in the production process.

for the disclosure of this paragraph see [0013.0.0.0] above.

Accordingly, in a first embodiment, the invention relates to a process for the production of a fine chemical, whereby the fine chemical is carotenoids, e.g. beta-carotene or its/their precursor, e.g. isopentyl pyrophosphate (IPP). Accordingly, in the present invention, the term "the fine chemical" as used herein relates to "carotenoids", e.g. "beta-carotene" or its/their precursor, e.g. "isopentyl pyrophosphate" ("IPP")". Further, the term "the fine chemicals" as used herein also relates to fine chemicals comprising carotenoids, e.g. beta-carotene or its/their precursor, e.g. isopentyl pyrophosphate (IPP).

In one embodiment, the term "carotenoids", "beta-carotene" or its/their precursor, e.g. "isopentyl pyrophosphate (IPP)" or "the fine chemical" or "the respective fine chemical" means at least one chemical compound with carotenoids, preferably beta-carotene or its/their precursor, preferably isopentyl pyrophosphate (IPP) activity selected from the group Isopentenylpyrophosphate (IPP) Geranylgeranylpyrophosphate (GGPP), Phytoene, Lycopene, zeta-carotene, beta-carotene. In another embodiment, the term "carotenoids, e.g. beta-carotene or its/their precursor, e.g. isopentyl pyrophosphate (IPP)" or "the fine chemical" or "the respective fine chemical" means at least one chemical compound with carotenoids, e.g. beta-carotene or its/their precursor, e.g. isopentyl pyrophosphate (IPP) activity selected from the group Isopentenylpyrophosphate (IPP) Geranylgeranylpyrophosphate (GGPP), Phytoene, Lycopene, zeta-carotene, beta-carotene. In an preferred embodiment, the term "the fine chemical" or the term "carotenoids, e.g. beta-carotene or its/their precursor, e.g. isopentyl pyrophosphate (IPP)" or the term "the respective fine chemical" means at least one chemical compound with carotenoids, e.g. beta-carotene or its/their precursor, e.g. isopentyl pyrophosphate (IPP) activity selected from the group "Isopentenylpyrophosphate (IPP)", "Geranylgeranylpyrophosphate (GGPP)", "Phytoene", "Lycopene", "zeta-carotene", and/or "beta-carotene".

An increased carotenoids, e.g. beta-carotene or its/their precursor, e.g. isopentyl pyrophosphate (IPP) content normally means an increased total carotenoids, e.g. betacarotene or its/their precursor, e.g. isopentyl pyrophosphate (IPP) content. However, an increased carotenoids, e.g. beta-carotene or its/their precursor, e.g. isopentyl pyrophosphate (IPP) content also means, in particular, a modified content of the above-described 6 compounds with carotenoids, e.g. beta-carotene or its/their precursor, e.g. isopentyl pyrophosphate (IPP) activity, without the need for an inevitable increase in the total carotenoids, e.g. beta-carotene or its/their precursor, e.g. isopentyl pyrophosphate (IPP) content. In a preferred embodiment, the term "the fine chemical" means carotenoids, e.g. beta-carotene or its/their precursor, e.g. isopentyl pyrophosphate (IPP) in free form or its salts or its ester or bound.

Accordingly, the present invention relates to a process for the production of carotenoids, e.g. beta-carotene or its/their precursor, e.g. isopentyl pyrophosphate (IPP), which comprises (a) increasing or generating the activity of a protein as shown in table II, application no. 25, column 3 encoded by the nucleic acid sequences as shown in table I, application no. 125, column 5, in an organelle of a microorganism or plant, or (b) increasing or generating the activity of a protein as shown in table II, application no. 25, column 3 encoded by the nucleic acid sequences as shown in table I, application no. 25, column 5 in the plastid of a microorganism or plant, or in one or more parts thereof; and (c) growing the organism under conditions which permit the production of the fine chemical, thus, carotenoids, e.g. beta-carotene or its/their precursor, e.g. isopentyl pyrophosphate (IPP) or fine chemicals comprising carotenoids, e.g. betacarotene or its/their precursor, e.g. isopentyl pyrophosphate (IPP), in said organism or in the culture medium surrounding the organism.

Accordingly, the term "the fine chemical" means in one embodiment "carotenoids, e.g. beta-carotene or its/their precursor, e.g. isopentyl pyrophosphate (IPP)" in relation to all sequences listed in Table I to IV, application no. 25 or homologs thereof;

Accordingly, in one embodiment the term "the fine chemical" means "carotenoids, e.g. beta-carotene or its/their precursor, e.g. isopentyl pyrophosphate (IPP)" in relation to all sequences listed in Table I to IV, application no. 25.

Accordingly, the term "the fine chemical" can mean "Isopentenylpyrophosphate (IPP)", "Geranylgeranylpyrophosphate (GGPP)", "Phytoene", "Lycopene", "zeta-carotene", and/or "beta-carotene"., owing to circumstances and the context.

In another embodiment the present invention is related to a process for the production of carotenoids, e.g. beta-carotene or its/their precursor, e.g. isopentyl pyrophosphate (IPP), which comprises
(a) increasing or generating the activity of a protein as shown in table II, application no. 6 column 3 encoded by the nucleic acid sequences as shown in table I, application no. 25, column 5, in an organelle of a non-human organism, or
(b) increasing or generating the activity of a protein as shown in table II, application no. 25, column 3 encoded by the nucleic acid sequences as shown in table I, application no. 125, column 5, which are joined to a nucleic acid sequence encoding a transit peptide in a non-human organism, or in one or more parts thereof; or
(c) increasing or generating the activity of a protein as shown in table II, application no. 25, column 3 encoded by the nucleic acid sequences as shown in table I, application no. 25, column 5, which are joined to a nucleic acid sequence encoding chloroplast localization sequence, in a non-human organism, or in one or more parts thereof, and
(d) growing the organism under conditions which permit the production of carotenoids, e.g. beta-carotene or its/their precursor, e.g. isopentyl pyrophosphate (IPP), in said organism.

In another embodiment, the present invention relates to a process for the production of carotenoids, e.g. beta-carotene or its/their precursor, e.g. isopentyl pyrophosphate (IPP), which comprises
(a) increasing or generating the activity of a protein as shown in table II, application no. 25, column 3 encoded by the nucleic acid sequences as shown in table I, application no. 25, column 5, in an organelle of a microorganism or plant through the transformation of the organelle, or
(b) increasing or generating the activity of a protein as shown in table II, application no. 25, column 3 encoded by the nucleic acid sequences as shown in table I, application no. 250, column 5 in the plastid of a microorganism or plant, or in one or more parts thereof through the transformation of the plastids; and
(c) growing the organism under conditions which permit the production of the fine chemical, thus, carotenoids, e.g. beta-carotene or its/their precursor, e.g. isopentyl pyrophosphate (IPP), or fine chemicals comprising carotenoids, e.g. beta-carotene or its/their precursor, e.g. isopentyl pyrophosphate (IPP), in said organism or in the culture medium surrounding the organism.

Advantagously the activity of the protein as shown in table II, application no. 25, column 3 encoded by the nucleic acid sequences as shown in table I, application no. 25, column 5 is increased or generated in the abovementioned process in the plastid of a microorganism or plant.

for the disclosure of the paragraphs [0019.0.0.24] to [0024.0.0.24] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 25, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II, application no. 25, column 3 and its homologs as disclosed in table I, application no. 25, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 25, column 3 and its homologs as disclosed in table I, application no. 25, columns 5 and 7.

for the disclosure of the paragraphs [0027.0.0.24] to [0029.0.0.24] see paragraphs [0027.0.0.0] and [0029.0.0.0] above.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 25, columns 5 and 7. The person skilled in the art is able to join said sequences in a functional manner. Advantageously the transit peptide part is cleaved off from the protein part shown in table II, application no. 25, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II, application no. 25, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II, application no. 25, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I, application no. 25, columns 5 and 7. Furthermore the skilled worker is aware of the fact that there is not a need for such short sequences in the expression of the genes.

Table V: Examples of transit peptides disclosed by von Heijne et al. for the disclosure of Table V see paragraph [0030.2.0.0] above.

Alternatively to the targeting of the sequences shown in table II, application no. 25, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I, application no. 25, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

for the disclosure of the paragraphs [0030.2.0.24] and [0030.3.0.24] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 25, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table 1, application no. 25, columns 5 and 7 or a sequence encoding a protein, as depicted in table II, application no. 25, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table, 1, application no. 25, columns 5 and 7 or a sequence encoding a protein, as depicted in table II, application no. 25, columns 5 and 7 in such a manner that the viroid sequence transports a sequence transcribed from a sequence as depicted in table 1 application no. 25, columns 5 and 7 or a sequence encoding a protein as depicted in table II, application no. 25, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II, application no. 25, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, application no. 25, columns 5 and 7.

In a preferred embodiment of the invention the nucleic acid sequences as shown in table I, application no. 25, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 25, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.24] and [0032.0.0.24] see paragraphs [0031.0.0.0] and [0032.0.0.0] above.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as shown in table II, application no. 25, column 3. Preferably the modification of the activity of a protein as shown in table II, application no. 25, column 3 or their combination can be achieved by joining the protein to a transit peptide.

Surprisingly it was found, that the transgenic expression of the *E. coli* or *Saccharomyces cerevisiae* proteins shown in table II, application no. 25, column 3 in plastids of a plant such as *Arabidopsis thaliana* for example through the linkage to at least one targeting sequence—for example as mentioned in table V—conferred an increase in the respective fine chemical indicated in column 6 "metabolite" of each table I to IV in the transformed plant.

Surprisingly it was found, that the transgenic expression of the *E. coli* protein b0931, b1868and/or b2032 and of the *Saccharomyces cerevisiae* protein YLR099C and/or YPL080C in *Arabidopsis thaliana* conferred an increase in the isopentyl pyrophosphate (IPP) content, which is a precursor in the biosynthesis of carotenoids, e.g. beta-carotene or its/their precursors like Geranylgeranylpyrophosphate (GGPP), Phytoene, Lycopene, zeta-carotene, in particular of isopentyl pyrophosphate (IPP), and thus of carotenoids, e.g. beta-carotene or its/their precursor. Thus, an increase in the level of this precursor of the carotenoids, e.g. beta-carotene bioynthesis can be advantageous for the production of carotenoids, e.g. beta-carotene or its/their precursor Geranylgeranylpyrophosphate (GGPP), Phytoene, Lycopene, zeta-carotene. For example, in one embodiment the level of carotenoids, e.g. beta-carotene or its/their precursor, e.g. isopentyl pyrophosphate (IPP), is increased in combination with the modulation of the expression of other genes of the biosynthesis of other carotenoids, e.g. alpha-carotene, lutein, zeaxanthine or its/their precursors, in particular of genes encoding enzymes metabolising carotenoids or a precursor thereof, such as the Isopentenyl diphosphate isomerase, Geranylgeranyl diphosphate synthase, Phytoene synthase, Phytoene desaturase, zeta-Carotene desaturase, beta-Cyclase, beta-Hydroxylase.

for the disclosure of this paragraph see paragraph [0035.0.0.0] above.

The sequence of bO931 (Accession number JQ0756) from *Escherichia coli* has been published in Blattner et al., Science 277 (5331), 1453-1474 (1997), and its activity is being defined as "nicotinate phosphoribosyltransferase". Accordingly, in one embodiment, the process of the present invention comprises the use of a "nicotinate phosphoribosyltransferase" or its homolog, e.g. as shown herein, for the production of the fine chemical, meaning of carotenoids, e.g. beta-carotene or its/their precursor, e.g. isopentyl pyrophosphate (IPP), in particular for increasing the amount of carotenoids, e.g. beta-carotene or its/their precursor, e.g. isopentyl pyrophosphate (IPP), in free or bound form in an organism or a part thereof, as mentioned. In one embodiment, in the process of the present invention the activity of a b0931 protein is increased or generated, e.g. from *Escherichia coli* or a homolog thereof, preferably linked at least to one transit peptide as mentioned for example in table V.

In another embodiment, in the process of the present invention the activity of a b0931 protein is increased or generated in a subcellular compartment of the organism or organism cell such as in an organelle like a plastid or mitochondria.

The sequence of b1868 (Accession number D64949) from *Escherichia coli* has been published in Blattner et al., Science 277 (5331), 1453-1474 (1997), and its activity is being defined as "yecE protein". Accordingly, in one embodiment, the process of the present invention comprises the use of a "yecE protein" or its homolog, e.g. as shown herein, for the production of the fine chemical, meaning of carotenoids, e.g. beta-carotene or its/their precursor, e.g. isopentyl pyrophosphate (IPP), in particular for increasing the amount of carotenoids, e.g. beta-carotene or its/their precursor, e.g. isopentyl pyrophosphate (IPP), in free or bound form in an organism or a part thereof, as mentioned. In one embodiment, in the process of the present invention the activity of a b1868 protein is increased or generated, e.g. from *Escherichia coli* or a homolog thereof, preferably linked at least to one transit peptide as mentioned for example in table V.

In another embodiment, in the process of the present invention the activity of a b1868 protein is increased or generated in a subcellular compartment of the organism or organism cell such as in an organelle like a plastid or mitochondria.

The sequence of b2032 (Accession number I69647) from *Escherichia coli* has been published in Blattner et al., Science 277 (5331), 1453-1474 (1997), and its activity is being defined as "glycosyltransferase". Accordingly, in one embodiment, the process of the present invention comprises the use of a "glycosyltransferase" or its homolog, e.g. as shown herein, for the production of the fine chemical, meaning of carotenoids, e.g. beta-carotene or its/their precursor, e.g. isopentyl pyrophosphate (IPP), in particular for increasing the amount of carotenoids, e.g. beta-carotene or its/their precursor, e.g. isopentyl pyrophosphate (IPP), in free or bound form in an organism or a part thereof, as mentioned. In one embodiment, in the process of the present invention the activity of a b2032 protein is increased or generated, e.g. from *Escherichia coli* or a homolog thereof, preferably linked at least to one transit peptide as mentioned for example in table V. In another embodiment, in the process of the present invention the activity of a b2032 protein is increased or generated in a subcellular compartment of the organism or organism cell such as in an organelle like a plastid or mitochondria.

The sequence of YLR099C (Accession number NP_013200) from *Saccharomyces cerevisiae* has been published in Goffeau et al., Science 274 (5287), 546-547, 1996, and its activity is being defined as "lipase". Accordingly, in one embodiment, the process of the present invention comprises the use of a "lipase" or its homolog, e.g. as shown herein, for the production of the fine chemical, meaning of carotenoids, e.g. beta-carotene or its/their precursor, e.g. isopentyl pyrophosphate (IPP), in particular for increasing the amount of carotenoids, e.g. beta-carotene or its/their precursor, e.g. isopentyl pyrophosphate (IPP) in free or bound form in an organism or a part thereof, as mentioned. In one embodiment, in the process of the present invention the activity of a YLR0990C protein is increased or generated, e.g. from *Saccharomyces cerevisiae* or a homolog thereof, preferably linked at least to one transit peptide as mentioned for example in table V.

In another embodiment, in the process of the present invention the activity of an YLR099C protein is increased or generated in a subcellular compartment of the organism or organism cell such as in an organelle like a plastid or mitochondria.

The sequence of YPL080C (Accession number S61107) from *Saccharomyces cerevisiae* has been published in Goffeau et al., Science 274 (5287), 546-547, 1996, and its activity is being defined as "uncharacterised I protein". Accordingly, in one embodiment, the process of the present invention comprises the use of a "uncharacterised protein" or its homolog, e.g. as shown herein, for the production of the fine chemical, meaning of linoleic acid and/or triglycerides, lipids, oils and/or fats containing linoleic acid, in particular for increasing the amount of meaning of carotenoids, e.g. beta-carotene or its/their precursor, e.g. isopentyl pyrophosphate (IPP), in particular for increasing the amount of carotenoids, e.g. beta-carotene or its/their precursor, e.g. isopentyl pyrophosphate (IPP) in free or bound form in an organism or a part thereof, as mentioned. In one embodiment, in the process of the present invention the activity of a YPL080C protein is increased or generated, e.g. from *Saccharomyces cerevisiae* or a homolog thereof, preferably linked at least to one transit peptide as mentioned for example in table V.

In another embodiment, in the process of the present invention the activity of an YPL080C protein is increased or generated in a subcellular compartment of the organism or organism cell such as in an organelle like a plastid or mitochondria.

In one embodiment, the homolog of the YLR099C and/or YPL080C, is a homolog having said activity and being derived from *Eukaryot*. In one embodiment, the homolog of the b0931, b1868 and/or b2032 is a homolog having said activity and being derived from bacteria. In one embodiment, the homolog of the YLR099C and/or YPL080C is a homolog having said activity and being derived from Fungi. In one embodiment, the homolog of the b0931, b1868 and/or b2032 is a homolog having said activity and being derived from Proteobacteria. In one embodiment, the homolog of the YLR099C and/or YPL080C is a homolog having said activity and being derived from Ascomycota. In one embodiment, the homolog of the b0931, b1868 and/or b2032 is a homolog having said activity and being derived from Gammaproteobacteria. In one embodiment, the homolog of the YLR099C and/or YPL080C is a homolog having said activity and being derived from *Saccharomycotina*. In one embodiment, the homolog of the b0931, b1868 and/or b2032 is a homolog having said activity and being derived from *Enterobacteriales*. In one embodiment, the homolog of the YLR099C and/or YPL080C is a homolog having said activity and being derived from *Saccharomycetes*. In one embodiment, the homolog of the b0931, b1868 and/or b2032 is a homolog having said activity and being derived from *Enterobacteriaceae*. In one embodiment, the homolog of the YLR099C and/or YPL080C is a homolog having said activity and being derived from *Saccharomycetales*. In one embodiment, the homolog of the b0931, b1868 and/or b2032 is a homolog having said activity and being derived from *Escherichia*, preferably from *Escherichia coli*. In one embodiment, the homolog of the YLR099C and/or YPL080C is a homolog having said activity and being derived from Saccharomycetaceae. In one embodiment, the homolog of the YLR099C and/or YPL080C is a homolog having said activity and being derived from *Saccharomycetes*, preferably from *Saccharomyces cerevisiae*.

Homologs of the polypeptide table II, application no. 25, column 5 may be the polypeptides encoded by the nucleic acid molecules indicated in table I, application no. 25, column 7, resp., or may be the polypeptides indicated in table II, application no. 25, column 7, resp.

for the disclosure of this paragraph see paragraph [0038.0.0.0] above.

In accordance with the invention, a protein or polypeptide has the "activity of an protein as shown in table II, application no. 25, column 3" if its de novo activity, or its increased expression directly or indirectly leads to an increased in the level of the fine chemical indicated in the respective line of table II, application no. 25, column 6 "metabolite" in the organism or a part thereof, preferably in a cell of said organism, more preferably in an organelle such as a plastid or mitochondria of said organism The protein has the above mentioned activities of a protein as shown in table II, application no. 25, column 3, preferably in the event the nucleic acid sequences encoding said proteins is functionally joined to the nucleic acid sequence of a transit peptide.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, application no. 25, column 3, or which has at least 10% of the original enzymatic activity, preferably 20%, particularly preferably 30%, most particularly preferably 40% in comparison to a protein as shown in the respective line of table II, application no. 25, column 3 of *E. coli*.

for the disclosure of the paragraphs [0040.0.0.24] to [0047.0.0.24] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a respective protein as shown in table II, application no. 25, column 3 its biochemical or genetical causes and the increased amount of the respective fine chemical.

for the disclosure of the paragraphs [0049.0.0.24] to [0051.0.0.24] see paragraphs [0049.0.0.0] to [0051.0.0.0] above.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein, preferably the nucleic acid molecules as mentioned in table I, application no. 25, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modify the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.24] to [0058.0.0.24] see paragraphs [0053.0.0.0] to [0058.0.0.0] above.

In case the activity of the *Escherichia coli* protein b0931 or its homologs, e.g. a "nicotinate phosphoribosyltransferase" is increased advantageously in an organelle such as a plastid or mitochondria, preferably, in one embodiment an increase of the fine chemical, preferably of carotenoids, e.g. beta-carotene or its/their precursor, e.g. isopentyl pyrophosphate (IPP) between 60% and 148% or more is conferred.

In case the activity of the *Escherichia coli* protein b1868 or its homologs, e.g. a "yecE protein" is increased advantageously in an organelle such as a plastid or mitochondria, preferably, in one embodiment an increase of the fine chemical, preferably of carotenoids, e.g. beta-carotene or its/their precursor, e.g. isopentyl pyrophosphate (IPP) between 35% and 40% or more is conferred.

In case the activity of the *Escherichia coli* protein b2032 or its homologs, e.g. a "glycosyltransferase" is increased advantageously in an organelle such as a plastid or mitochondria, preferably, in one embodiment an increase of the fine chemical, preferably of carotenoids, e.g. beta-carotene or its/their precursor, e.g. isopentyl pyrophosphate (IPP) between 40% and 68% or more is conferred.

In case the activity of the *Saccharomyces cerevisiae* protein YLR099C or its homologs, e.g. a "lipase" is increased advantageously in an organelle such as a plastid or mitochondria, preferably, in one embodiment an increase of the fine chemical, preferably of carotenoids, e.g. beta-carotene or its/their precursor, e.g. isopentyl pyrophosphate (IPP) between 218% and 351% or more is conferred.

In case the activity of the *Saccharomyces cerevisiae* protein YPL080C or its homologs, e.g. a "uncharacterized protein" is increased advantageously in an organelle such as a plastid or mitochondria, preferably, in one embodiment an increase of the fine chemical, preferably of linoleic acid and/or triglycerides, lipids, oils and/or fats containing linoleic acid between 50% and 146% or more is conferred.

In one embodiment, the activity of any on of the *Escherichia coli* proteins b0931, b1868 and/or b2032 and/or of the *Saccharomyces cerevisiae* proteins YLR099C and/or YPL080C or their homologs," is advantageously are increased in an organelle such as a plastid or mitochondria, preferably conferring an increase of the fine chemical indicated in column 6 "metabolites" for application no. 25 in any one of Tables I to IV, resp., for the disclosure of the paragraphs [0061.0.0.24] and [0062.0.0.24] see paragraphs [0061.0.0.0] and [0062.0.0.0] above.

A protein having an activity conferring an increase in the amount or level of the fine chemical, preferably upon targeting to the plastids, has in one embodiment the structure of the polypeptide described herein, in particular of the polypeptides comprising the consensus sequence shown in table IV, application no. 250, column 7 or of the polypeptide as shown in the amino acid sequences as disclosed in table II, application no. 250, columns 5 and 7 or the functional homologues thereof as described herein, or is encoded by the nucleic acid molecule characterized herein or the nucleic acid molecule according to the invention, for example by the nucleic acid molecule as shown in table I, application no. 10, columns 5 and 7 or its herein described functional homologues and has the herein mentioned activity.

For the purposes of the present invention, the reference to the fine chemical, e.g. to the term "carotenoids", e.g. "beta-carotene" or "its/their precursor", e.g. "isopentyl pyrophosphate (IPP)", also encompasses the corresponding salts, such as, for example, the potassium or sodium salts or the salts with amines such as diethylamine as well as their ester, or glucoside thereof, e.g. the diglucoside thereof [0065.0.0.24] and [0066.0.0.24] for the disclosure of the paragraphs [0065.0.0.24] and [0066.0.0.24] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II, application no. 25, columns 5 and 7 or its homologs activity having herein-mentioned carotenoids, e.g. beta-carotene or its/their precursor, e.g. isopentyl pyrophosphate (IPP), increasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as shown in table I, application no. 25, columns 5 and 7, e.g. a nucleic acid sequence encoding a polypeptide having the activity of a protein as indicated in table II, application no. 25, columns 5 and 7 or its homologs activity or of a mRNA encoding the polypeptide of the present invention having herein-mentioned carotenoids, e.g. beta-carotene or its/their precursor, e.g. isopentyl pyrophosphate (IPP), increasing activity; and/or c) increasing the specific activity of a protein conferring the increased expression of a protein encoded by the nucleic acid molecule of the invention or of the polypeptide of the present invention having herein-mentioned carotenoids, e.g. beta-carotene or its/their precursor, e.g. isopentyl pyrophosphate (IPP), increasing activity, e.g. of a polypeptide having the activity of a protein as indicated in table II, application no. 25, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned carotenoids, e.g. beta-carotene or its/their precursor, e.g. isopentyl pyrophosphate (IPP), increasing activity, e.g. of a polypeptide having the activity of a protein as indicated in table II, application no. 25, columns 5 and 7 or its homologs activity; and/or e) stimulating activity of a protein conferring the increased expression of a protein encoded by the nucleic acid molecule of the present invention or a polypeptide of the present invention having herein-mentioned carotenoids, e.g. beta-carotene or its/their precursor, e.g. isopentyl pyrophosphate (IPP), increasing activity, e.g. of a polypeptide having the activity of a protein as indicated in table II, application no. 25, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned carotenoids, e.g. beta-carotene or its/their precursor, e.g. isopentyl pyrophosphate (IPP), increasing activity, e.g. of a polypeptide having the activity of a protein as indicated in table II, application no. 25, columns 5 and 7 or its homologs activity, and/or g) increasing the copy number of a gene conferring the increased expression of a nucleic acid molecule encoding a polypeptide encoded by the nucleic acid molecule of the invention or the polypeptide of the invention having herein-mentioned carotenoids, e.g. beta-carotene or its/their precursor, e.g. isopentyl pyrophosphate (IPP), increasing activity, e.g. of a polypeptide having the activity of a protein as indicated in table II, application no. 25, columns 5 and 7 or its homologs activity; and/or h) increasing the expression of the endogenous gene encoding the polypeptide of the invention, e.g. a polypeptide having the activity of a protein as indicated in table II, application no. 25, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned carotenoids, e.g. beta-carotene or its/their precursor, e.g. isopentyl pyrophosphate (IPP), increasing activity, e.g. of polypeptide having the activity of a protein as indicated in table II, application no. 25, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned carotenoids, e.g. beta-carotene or its/their precursor, e.g. isopentyl pyrophosphate (IPP), increasing activity, e.g. of a polypeptide having the activity of a protein as indicated in table II, application no. 25, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned carotenoids, e.g. beta-carotene or its/their precursor, e.g. isopentyl pyrophosphate (IPP), increasing activity, e.g. of a polypeptide having the activity of a protein as indicated in table II, application no. 25, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or link to a transit nucleic acid sequence or transit peptide encoding nucleic acid sequence or the polypeptide having the herein mentioned activity, e.g. conferring the increase of the respective fine chemical as indicated in column 6 of application no. 25 in Table I to IV, resp., after increasing the expression or activity of the encoded polypeptide preferably in organelles such as plastids or having the activity of a polypeptide having an activity as the protein as shown in table II, application no. 25, column 3 or its homologs. Preferably the increase of the fine chemical takes place in plastids.

for the disclosure of the paragraphs [0069.0.0.24] to [0079.0.0.24] see paragraphs [0069.0.0.0] to [0079.0.0.0] above.

The activation of an endogenous polypeptide having above-mentioned activity, e.g. having the activity of a protein as shown in table II, application no. 10, column 3 or of the polypeptide of the invention, e.g. conferring the increase of the respective fine chemical after increase of expression or activity in the cytsol and/or in an organelle like a plastid, preferentially in the plastid, can also be increased by introducing a synthetic transcription factor, which binds close to the coding region of the gene encoding the protein as shown in table II, application no. 25, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 25, column 3. The expression of the chimeric transcription factor in a organism, in particular in a plant, leads to a specific expression of the protein as shown in table II, application no. 25, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.24] to [0084.0.0.24] see paragraphs [0081.0.0.0] to [0084.0.0.0] above.

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below into an organism alone or in combination with other genes, it is possible not only to increase the biosynthetic flux towards the end product, but also to increase, modify or create de novo an advantageous, preferably novel metabolites composition in the organism, e.g. an advantageous carotinoid composition comprising a higher content of (from a viewpoint of nutritional physiology limited) carotinoids, like xanthopylls, like violaxanthin, antheraxanthin, lutein, astaxanthin, canthaxanthin and/or fucoxanthin or its precursor like Isopentenylpyrophosphate (IPP) Geranylgeranylpyrophosphate (GGPP), Phytoene, Lycopene, zeta-carotene, beta-carotene or.

for the disclosure of this paragraph see paragraph [0086.0.0.0] above.

By influencing the metabolism thus, it is possible to produce, in the process according to the invention, further advantageous compounds. Examples of such compounds are further vitamins or provitamins or carotenoids.

Accordingly, in one embodiment, the process according to the invention relates to a process, which comprises:
a) providing a non-human organism, preferably a microorganism, a non-human animal, a plant or animal cell, a plant or animal tissue or a plant, more preferably a microorganism, a plant or a plant tissue;
b) increasing the activity of a protein as shown in table II, application no. 25, column 3 or of a polypeptide being encoded by the nucleic acid molecule of the present invention and described below, e.g. conferring an increase of the respective fine chemical as indicated in any one of Tables I to IV, application no. 25, column 6 "metabolite" in the organism, preferably in the microorganism, the non-human animal, the plant or animal cell, the plant or animal tissue or the plant, more preferably a microorganism, a plant or a plant tissue, in the cytsol or in the plastids, preferentially in the plastids,
c) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and
d) if desired, recovering, optionally isolating, the respective free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the respective fine chemical but as option it is also possible to produce, recover and, if desired isolate, other free or/and bound carotenoids, vitamins, provitamins etc.

for the disclosure of the paragraphs [0090.0.0.24] to [0097.0.0.24] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) the nucleic acid sequence as shown in table I, application no. 25, columns 5 and 7 or a derivative thereof, or
b) a genetic regulatory element, for example a promoter, which is functionally linked to the nucleic acid sequence as shown table I, application no. 25, columns 5 and 7 or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I, application no. 25, columns 5 and 7 joined to a nucleic acid sequence encoding a transit peptide, or a targeting nucleic acid sequence which directs the nucleic acid sequences disclosed in table I, application no. 25, columns 5 and 7 to the organelle preferentially the plastids. Alternatively the inventive nucleic acids sequences consist advantageously of the nucleic acid sequences as depicted in the sequence protocol and disclosed in table I, application no. 25, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose carotenoids, e.g. beta-carotene or its/their precursor, e.g. isopentyl pyrophosphate (IPP), content is modified advantageously owing to the nucleic acid molecule of the present invention expressed. This is important for plant breeders since, for example, the nutritional value of plants for poultry is dependent on the abovementioned carotenoids as vitamin source, free radical scavenger and/or dye source in feed. Further, this is also important for the production of cosmetic compostions since, for example, the antioxidant level of plant extracts is depending on the abovementioned carotenoids and the general amount of vitamins e.g. as antioxidants.

After the activity of the protein as shown in table II, application no. 25, column 3 has been increased or generated, or after the expression of nucleic acid molecule or polypeptide according to the invention has been generated or increased, the transgenic plant generated thus is grown on or in a nutrient medium or else in the soil and subsequently harvested.

for the disclosure of the paragraphs [0102.0.0.24] to [0110.0.0.24] see paragraphs [0102.0.0.0] to [0110.0.0.0] above.

In a preferred embodiment, the respective fine chemical (carotenoids, e.g. beta-carotene or its/their precursor, e.g. isopentyl pyrophosphate (IPP),) is produced in accordance with the invention and, if desired, is isolated. The production of further vitamins, provitamins or carotenoids, e.g. carotenes or xanthophylls, or mixtures thereof or mixtures with other compounds by the process according to the invention is advantageous.

Thus, the content of plant components and preferably also further impurities is as low as possible, and the abovementioned carotenoids, e.g. beta-carotene or its/their precursor, e.g. isopentyl pyrophosphate (IPP), are obtained in as pure form as possible. In these applications, the content of plant components advantageously amounts to less than 10%, preferably 1%, more preferably 0.1%, very especially preferably 0.01% or less.

In another preferred embodiment of the invention a combination of the increased expression of the nucleic acid sequence or the protein of the invention together with the transformation of a protein or polypeptide or a compound, which functions as a sink for the desired fine chemical, for example carotenoids, e.g. beta-carotene or its/their precursor, e.g. isopentyl pyrophosphate (IPP), in the organism, is useful to increase the production of the respective fine chemical.

In the case of the fermentation of microorganisms, the abovementioned carotenoids, e.g. beta-carotene or its/their precursor, e.g. isopentyl pyrophosphate (IPP), may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, spray granulation or by other methods. Preferably the the respective fine chemical or the carotenoids, e.g. beta-carotene or its/their precursor, e.g. isopentyl pyrophosphate (IPP), comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the carotenoids, e.g. beta-carotene or its/their precursor, e.g. isopentyl pyrophosphate (IPP), synthesized in the process according to the invention can advantageously be marketed directly without there being any need for carotenoids, e.g. beta-carotene or its/their precursor, e.g. isopentyl pyrophosphate (IPP), synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

The site of carotenoids, e.g. beta-carotene or its/their precursor, e.g. isopentyl pyrophosphate (IPP), biosynthesis in plants is, inter alia, the leaf tissue or florescence so that the isolation of these tissues makes sense. However, this is not limiting, since the expression may also take place in a tissue-specific manner in all of the remaining parts of the plant, in particular in fat-containing seeds. A further preferred embodiment therefore relates to a seed-specific isolation of carotenoids, e.g. beta-carotene or its/their precursor, e.g. isopentyl pyrophosphate (IPP).

However, the respective fine chemical produced in the process according to the invention can also be isolated from the organisms, advantageously plants, in the form of their oils, fats, lipids, glycosides as extracts, e.g. ether, alcohol, or other organic solvents or water containing extract and/or free carotenoids, e.g. beta-carotene or its/their precursor, e.g. isopentyl pyrophosphate (IPP). The respective fine chemical produced by this process can be obtained by harvesting the organisms, either from the crop in which they grow, or from the field. This can be done via pressing or extraction of the plant parts, preferably the plant seeds. To increase the efficiency of oil extraction it is beneficial to clean, to temper and if necessary to hull and to flake the plant material especially the seeds. e.g. the oils, fats, lipids, extracts, e.g. ether, alcohol, or other organic solvents or water containing extract and/or free carotenoids, e.g. beta-carotene or its/their precursor, e.g. isopentyl pyrophosphate (IPP), can be obtained by what is known as cold beating or cold pressing without applying heat. To allow for greater ease of disruption of the plant parts, specifically the seeds, they are previously comminuted, steamed or roasted. The seeds, which have been pretreated in this manner can subsequently be pressed or extracted with solvents such as preferably warm hexane. The solvent is subsequently removed. In the case of microorganisms, the latter are, after harvesting, for example extracted directly without further processing steps or else, after disruption, extracted via various methods with which the skilled worker is familiar. In this manner, more than 96% of the compounds produced in the process can be isolated. Thereafter, the resulting products are processed further, i.e. degummed and/or refined. In this process, substances such as the plant mucilages and suspended matter are first removed. What is known as desliming can be affected enzymatically or, for example, chemico-physically by addition of acid such as phosphoric acid.

Because carotenoids in microorganisms are localized intracellular, their recovery essentials comes down to the isolation of the biomass. Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose. However, it can be advantageous to avoid this treatment as it can result in cells devoid of most carotenoids.

Carotenoids, can for example be analyzed advantageously via HPLC or GC or LC separation methods and detected by MS oder MSMS methods. The unambiguous detection for the presence of carotenoids, e.g. beta-carotene or its/their precursor, e.g. isopentyl pyrophosphate (IPP), containing products can be obtained by analyzing recombinant organisms using analytical standard methods: LC, LC-MS, GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353). The material to be analyzed can be disrupted by sonication, grinding in a glass mill, liquid nitrogen and grinding, cooking, or via other applicable methods; see also Biotechnology of Vitamins, Pigments and Growth Factors, Edited by Erik J. Vandamme, London, 1989, p. 96 to 103.

In a preferred embodiment, the present invention relates to a process for the production of the respective fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide shown in table II, application no. 25, columns 5 and 7 or a fragment thereof, which confers an increase in the amount of the respective fine chemical in an organism or a part thereof;
b) nucleic acid molecule comprising, preferably at least the mature form, of the nucleic acid molecule shown in table I, application no. 25, columns 5 and 7;
c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;
e) nucleic acid molecule which hybidizes with a nucleic acid molecule of (a) to (c) under stringent hybridisation conditions and conferring an increase in the amount of the respective fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;
h) nucleic acid molecule comprising a nucleic acid molecule which is obtained by amplifying nucleic acid molecules from a cDNA library or a genomic library using the primers shown in table II, application no. 25, column 7 and conferring an increase in the amount of the respective fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;
j) nucleic acid molecule which encodes a polypeptide comprising the consensus sequence shown in table IV, application no. 25, column 7 and conferring an increase in the amount of the respective fine chemical in an organism or a part thereof;
k) nucleic acid molecule comprising one or more of the nucleic acid molecule encoding the amino acid sequence of a polypeptide encoding a domain of the polypeptide shown in table II, application no. 25, columns 5 and 7 and conferring an increase in the amount of the fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;
or which comprises a sequence which is complementary thereto.

In one embodiment, the nucleic acid molecule used in the process of the invention distinguishes over the sequence indicated in table IA, application no. 25, columns 5 and 7 by one or more nucleotides. In one embodiment, the nucleic acid molecule used in the process of the invention does not consist of the sequence indicated in table IA, application no. 25, columns 5 and 7. In one embodiment, the nucleic acid molecule used in the process of the invention is less than 100%, 99.999%, 99.99%, 99.9% or 99% identical to a sequence indicated in table IA, application no. 25, columns 5 and 7. In another embodiment, the nucleic acid molecule does not encode a polypeptide of a sequence indicated in table IIA, application no. 10, columns 5 and 7.

In one embodiment, the nucleic acid molecule used in the process of the invention distinguishes over the sequence indicated in table IB, application no. 25, columns 5 and 7, by one or more nucleotides. In one embodiment, the nucleic acid molecule used in the process of the invention does not consist of the sequence indicated in table IB, application no. 25, columns 5 and 7. In one embodiment, the nucleic acid molecule used in the process of the invention is less than 100%, 99.999%, 99.99%, 99.9% or 99% identical to a sequence indicated in table IB, application no. 25, columns 5 and 7. In another embodiment, the nucleic acid molecule does not encode a polypeptide of a sequence indicated in table IIB, application no. 25, columns 5 and 7.

In one embodiment, the nucleic acid molecule used in the process distinguishes over the sequence shown in table I, application no. 25, columns 5 and 7 by one or more nucleotides or does not consist of the sequence shown in table I, application no. 25, columns 5 and 7. In one embodiment, the nucleic acid molecule of the present invention is less than 100%, 99.999%, 99.99%, 99.9% or 99% identical to the sequence shown in table I, application no. 25, columns 5 and 7. In another embodiment, the nucleic acid molecule does not encode a polypeptide of the sequence shown in table II, application no. 25, columns 5 and 7.

for the disclosure of the paragraphs [0118.0.0.24] to [0120.0.0.24] see paragraphs [0118.0.0.0] to [0120.0.0.0] above.

The expression of nucleic acid molecules with the sequence shown in table I, application no. 25, columns 5 and 7, or nucleic acid molecules which are derived from the amino acid sequences shown in table II, application no. 25, columns 5 and 7 or from polypeptides comprising the consensus sequence shown in table IV, application no. 25, column 7, or their derivatives or homologues encoding polypeptides with the enzymatic or biological activity of a protein as shown in table II, application no. 25, column 3, and conferring an increase of the respective fine chemical (column 6 of application no. 25 in any one of Tables I to IV) after increasing its plastidic and/or specific activity in the plastids is advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II, application no. 25, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II, application no. 25, column 3 and which confer an increase in the level of the respective fine chemical indicated in table II, application no. 25, column 6 by being expressed either in the cytsol or in an organelle such as a plastid or mitochondria or both, preferably in plastids, and the gene product being localized in the plastid and other parts of the cell or in the plastid as described above.

for the disclosure of the paragraphs [0126.0.0.24] to [0133.0.0.24] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II, application no. 25, columns 5 and 7 or the functional homologues thereof as described herein, preferably conferring above-mentioned activity, i.e. conferring an increase of the respective fine chemical after increasing its plastidic activity, e.g. after increasing the activity of a protein as shown in table II, application no. 25, column 3 by—for example—expression either in the cytsol or in an organelle such as a plastid or mitochondria or both, preferably in plastids and the gene product, e.g. the polypeptide, being localized in the plastid and other parts of the cell or in the plastid as described above.

for the disclosure of the paragraphs [0135.0.0.24] to [0140.0.0.24] see paragraphs [0135.0.0.0] to [0140.0.0.0] above.

Synthetic oligonucleotide primers for the amplification, e.g. as shown in table III, application no. 25, column 7, by means of polymerase chain reaction can be generated on the basis of a sequence shown herein, for example the sequence shown in table I, application no. 25, columns 5 and 7 or the sequences derived from table II, application no. 25, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequence shown in table IV, application no. 25, column 7 is derived from said alignments.

Degenerated primers can then be utilized by PCR for the amplification of fragments of novel proteins having above-mentioned activity, e.g. conferring the increase of the fine chemical after increasing the expression or activity or having the activity of a protein as shown in table II, application no. 25, column 3 or further functional homologs of the polypeptide of the invention from other organisms.

for the disclosure of the paragraphs [0144.0.0.24 to [0151.0.0.24] see paragraphs [0144.0.0.0] to [0151.0.0.0] above.

Polypeptides having above-mentioned activity, i.e. conferring the increase of the respective fine chemical indicated in table I, application no. 25, column 6, and being derived from other organisms, can be encoded by other DNA sequences which hybridize to the sequences shown in table I, application no. 25, columns 5 and 7, preferably of table IB, application no. 25, columns 5 and 7 under relaxed hybridization conditions and which code on expression for peptides having the respective fine chemical, i.e. carotenoids, e.g. beta-carotene or its/their precursor, e.g. isopentyl pyrophosphate (IPP), increasing activity.

for the disclosure of the paragraphs [0153.0.0.24] to [0159.0.0.24] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 25, columns 5 and 7, preferably shown in table IB, application no. 25, columns 5 and 7 is one which is sufficiently complementary to one of the nucleotide sequences shown in table I, application no. 25, columns 5 and 7, preferably shown in table IB, application no. 25, columns 5 and 7 such that it can hybridize to one of the nucleotide sequences shown in table I, application no. 25, columns 5 and 7, preferably shown in table IB, application no. 25, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 25, columns 5 and 7, preferably shown in table IB, application no. 25, columns 5 and 7, or a portion thereof and preferably has above mentioned activity, in particular having a respective fine chemical increasing activity after increasing the activity or an activity of a gene product as shown in table II, application no. 25, column 3 by for example expression either in the cytsol or in an organelle such as a plastid or mitochondria or both, preferably in plastids, and the gene product, e.g. the polypeptide, being localized in the plastid and other parts of the cell or in the plastid as described above.

The nucleic acid molecule of the invention comprises a nucleotide sequence which hybridizes, preferably hybridizes under stringent conditions as defined herein, to one of the nucleotide sequences shown in table I, application no. 25, columns 5 and 7, preferably shown in table IB, application no. 25, columns 5 and 7, or a portion thereof and encodes a protein having above-mentioned activity, e.g. conferring of a carotenoids, e.g. beta-carotene or its/their precursor, e.g. isopentyl pyrophosphate (IPP), increase by for example expression either in the cytsol or in an organelle such as a plastid or mitochondria or both, preferably in plastids, and optionally, the activity of a protein as shown in table II, application no. 25, column 3, and the gene product, e.g. the polypeptide, being localized in the plastid and other parts of the cell or in the plastid as described above.

Moreover, the nucleic acid molecule of the invention can comprise only a portion of the coding region of one of the sequences shown in table I, application no. 25, columns 5 and 7, preferably shown in table IB, application no. 25, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase of the respective fine chemical indicated in Table I, application no. 25, column 6, if its activity is increased by for example expression either in the cytsol or in an organelle such as a plastid or mitochondria or both, preferably in plastids, and the gene product, e.g. the polypeptide, being localized in the plastid and other parts of the cell or in the plastid as described above. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, application no. 25, columns 5 and 7, an anti-sense sequence of one of the sequences, e.g., set forth in table I, application no. 25, columns 5 and 7, preferably shown in table IB, application no. 25, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 25, column 7 will result in a fragment of the gene product as shown in table II, column 3.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II, application no. 25, columns 5 and 7 such that the protein or portion thereof maintains the ability to participate in the fine chemical production, in particular an activity increasing the level of carotenoids, e.g. beta-carotene or its/their precursor, e.g. isopentyl pyrophosphate (IPP), resp., increasing the activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 25, columns 5 and 7 such that the protein or portion thereof is able to participate in the increase of the fine chemical production. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 25, columns 5 and 7 and having above-mentioned activity, e.g. conferring preferably the increase of the respective fine chemical by for example expression either in the cytsol or in an organelle such as a plastid or mitochondria or both, preferably in plastids, and the gene product, e.g. the polypeptide, being localized in the plastid and other parts of the cell or in the plastid as described above.

for the disclosure of the paragraphs [0168.0.0.24] and [0169.0.0.24] see paragraphs [0168.0.0.0] and [0169.0.0.0] above.

The invention further relates to nucleic acid molecules that differ from one of the nucleotide sequences shown in table I, application no. 25, columns 5 and 7 (and portions thereof) due to degeneracy of the genetic code and thus encode a polypeptide of the present invention, in particular a polypeptide having above mentioned activity, e.g. conferring an increase in the respective fine chemical in a organism, e.g. as that polypeptides depicted by the sequence shown in table II, application no. 25, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 25, columns 5 and 7 or the functional homologues. In a still further embodiment, the nucleic acid molecule of the invention encodes a full length protein which is substantially homologous to an amino acid sequence shown in table II, application no. 25, columns 5 and 7 or the functional homologues. However, in a preferred embodiment, the nucleic acid molecule of the present invention does not consist of the sequence shown in table I, application no. 25, columns 5 and 7, preferably as indicated in table IA, application no. 25, columns 5 and 7. Preferably the nucleic acid molecule of the invention is a functional homologue or identical to a nucleic acid molecule indicated in table IB, application no. 25, columns 5 and 7.

for the disclosure of the paragraphs [0171.0.0.24] to [0173.0.0.24] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 25, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I, application no. 25, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I, application no. 25, columns 5 and 7.

for the disclosure of the paragraphs [0179.0.0.24] and [0180.0.0.24] see paragraphs [0179.0.0.0] and [0180.0.0.0] above.

Accordingly, the invention relates to nucleic acid molecules encoding a polypeptide having above-mentioned activity, e.g. conferring an increase in the the respective fine chemical in an organisms or parts thereof by for example expression either in the cytsol or in an organelle such as a plastid or mitochondria or both, preferably in plastids (as described), that contain changes in amino acid residues that are not essential for said activity. Such polypeptides differ in amino acid sequence from a sequence contained in the sequences shown in table II, application no. 25, columns 5 and 7, preferably shown in table IIA, application no. 25, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 25, columns 5 and 7, preferably shown in table IIA, application no. 25, columns 5 and 7 and is capable of participation in the increase of production of the fine chemical after increasing its activity, e.g. its expression by for example expression either in the cytsol or in an organelle such as a plastid or mitochondria or both, preferably in plastids and the gene product, e.g. the polypeptide, being localized in the plastid and other parts of the cell or in the plastid as described above. Preferably, the protein encoded by the nucleic acid molecule is at least about 60% identical to the sequence shown in table II, application no. 25, columns 5 and 7, preferably shown in table IIA, application no. 25, columns 5 and 7, more preferably at least about 70% identical to one of the sequences shown in table II, application no. 25, columns 5 and 7, preferably shown in table IIA, application no. 25, columns 5 and 7, even more preferably at least about 80%, 90%, 95% homologous to the sequence shown in table II, application no. 25, columns 5 and 7, preferably shown in table IIA, application no. 25, columns 5 and 7, and most preferably at least about 96%, 97%, 98%, or 99% identical to the sequence shown in table II, application no. 25, columns 5 and 7, preferably shown in table IIA, application no. 25, columns 5 and 7.

for the disclosure of the paragraphs [0182.0.0.24] to [0188.0.0.24] see paragraphs [0182.0.0.0] to [0188.0.0.0] above.

Functional equivalents derived from one of the polypeptides as shown in table II, application no. 10, columns 5 and 7, preferably shown in table IIB, application no. 25, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 25, columns 5 and 7, preferably shown in table IIB, application no. 25, columns 5 and 7 resp., according to the invention and are distinguished by essentially the same properties as the polypeptide as shown in table II, application no. 25, columns 5 and 7, preferably shown in table IIB, application no. 25, columns 5 and 7.

Functional equivalents derived from the nucleic acid sequence as shown in table I, application no. 25, columns 5 and 7, preferably shown in table IB, application no. 25, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 25, columns 5 and 7, preferably shown in table IIB, application no. 25, columns 5 and 7 resp., according to the invention and encode polypeptides having essentially the same properties as the polypeptide as shown in table II, application no. 25, columns 5 and 7, preferably shown in table IIB, application no. 25, columns 5 and 7.

for the disclosure of this paragraph see paragraph [0191.0.0.0] above.

A nucleic acid molecule encoding an homologous to a protein sequence of table II, application no. 25, columns 5 and 7, preferably shown in table IIB, application no. 25, columns 5 and 7 resp., can be created by introducing one or more nucleotide substitutions, additions or deletions into a nucleotide sequence of the nucleic acid molecule of the present invention, in particular of table I, application no. 25, columns 5 and 7, preferably shown in table IB, application no. 25, columns 5 and 7 resp., such that one or more amino acid substitutions, additions or deletions are introduced into the encoded protein. Mutations can be introduced into the encoding sequences of table I, application no. 25, columns 5 and 7, preferably shown in table IB, application no. 25, columns 5 and 7 resp., by standard techniques, such as site-directed mutagenesis and PCR-mediated mutagenesis.

for the disclosure of the paragraphs [0193.0.0.24] to [0196.0.0.24] see paragraphs [0193.0.0.0] to [0196.0.0.0] above.

Homologues of the nucleic acid sequences used, with the sequence shown in table I, application no. 25, columns 5 and 7, preferably shown in table IB, application no. 25, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 25, columns 5 and 7, preferably shown in table IB, application no. 25, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 25, columns 5 and 7, preferably shown in table IB, application no. 25, columns 5 and 7. It is preferred that the nucleic acid molecule comprises as little as possible other nucleotides not shown in any one of table I, application no. 25, columns 5 and 7, preferably shown in table IB, application no. 25, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 25, columns 5 and 7, preferably shown in table IB, application no. 25, columns 5 and 7.

Also preferred is that the nucleic acid molecule used in the process of the invention encodes a polypeptide comprising the sequence shown in table II, application no. 25, columns 5 and 7, preferably shown in table IIB, application no. 25, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 25, columns 5 and 7, preferably shown in table IIB, application no. 25, columns 5 and 7.

In one embodiment, the nucleic acid molecule of the invention or used in the process encodes a polypeptide comprising the sequence shown in table II, application no. 25, columns 5 and 7, preferably shown in table IIB, application no. 25, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 25, columns 5 and 7, preferably shown in table IB, application no. 25, columns 5 and 7.

Polypeptides (=proteins), which still have the essential biological or enzymatic activity of the polypeptide of the present invention conferring an increase of the respective fine chemical indicated in column 6 of Table I, application no. 25, i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 25, columns 5 and 7 expressed under identical conditions.

Homologues of table I, application no. 25, columns 5 and 7 or of the derived sequences of table II, application no. 25, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.24] to [0215.0.0.24] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II, application no. 25, columns 5 and 7, preferably in table IIB, application no. 25, columns 5 and 7; or a fragment thereof conferring an increase of the fine chemical according to table IIB, application no. 25, column 6 in an organism or a part thereof b) nucleic acid molecule comprising, preferably at least the mature form, of the nucleic acid molecule shown in table I, application no. 25, columns 5 and 7, preferably in table IB, application no. 25, columns 5 and 7 or a fragment thereof conferring an increase in the amount of the fine chemical according to table IIB, application no. 25, column 6 in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical according to table IIB, application no. 25, column 6 in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical according to table IIB, application no. 25, column 6 in an organism or a part thereof;

e) nucleic acid molecule which hybridizes with a nucleic acid molecule of (a) to (c) under stringent hybridisation conditions and conferring an increase in the amount of the fine chemical according to table IIB, application no. 25, column 6 in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical according to table IIB, application no. 25, column 6 in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical according to table IIB, application no. 25, column 6 in an organism or a part thereof;

h) nucleic acid molecule comprising a nucleic acid molecule which is obtained by amplifying a cDNA library or a genomic library using the primers in table II, application no. 25, column 7 and conferring an increase in the amount of the fine chemical according to table IIB, application no. 25, column 6 in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence shown in table IV, application no. 25, column 7 and conferring an increase in the amount of the fine chemical in an organism or a part thereof;

k) nucleic acid molecule encoding the amino acid sequence of a polypeptide encoding a domain of the polypeptide shown in table II, application no. 252, columns 5 and 7 and conferring an increase in the amount of the fine chemical according to table IIB, application no. 25, column 6 in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a)

to (h) or of the nucleic acid molecule shown in table I, application no. 25, columns 5 and 7 or a nucleic acid molecule encoding, preferably at least the mature form of, the polypeptide shown in table II, application no. 25, columns 5 and 7, and conferring an increase in the amount of the fine chemical according to table II B, application no. 25, column 6 in an organism or a part thereof; or which encompasses a sequence which is complementary thereto; whereby, preferably, the nucleic acid molecule according to (a) to (l) distinguishes over the sequence depicted in table I A and/or I B, application no. 25, columns 5 and 7 by one or more nucleotides. In one embodiment, the nucleic acid molecule of the invention does not consist of the sequence shown in table I A and/or I B, application no. 25, columns 5 and 7. In an other embodiment, the nucleic acid molecule of the present invention is at least 30% identical and less than 100%, 99.999%, 99.99%, 99.9% or 99% identical to the sequence shown in table I A and/or I B, application no. 25, columns 5 and 7. In a further embodiment the nucleic acid molecule does not encode the polypeptide sequence shown in table II A and/or II B, application no. 25, columns 5 and 7. Accordingly, in one embodiment, the nucleic acid molecule of the present invention encodes in one embodiment a polypeptide which differs at least in one or more amino acids from the polypeptide shown in table II A and/or II B, application no. 252, columns 5 and 7 does not encode a protein of the sequence shown in table II A and/or II B, application no. 25, columns 5 and 7. Accordingly, in one embodiment, the protein encoded by a sequence of a nucleic acid according to (a) to (l) does not consist of the sequence shown in table I A and/or I B, application no. 25, columns 5 and 7. In a further embodiment, the protein of the present invention is at least 30% identical to protein sequence depicted in table II A and/or II B, application no. 25, columns 5 and 7 and less than 100%, preferably less than 99.999%, 99.99% or 99.9%, more preferably less than 99%, 985, 97%, 96% or 95% identical to the sequence shown in table II A and/or II B, application no. 25, columns 5 and 7.

for the disclosure of the paragraphs [0217.0.0.24] to [0226.0.0.24] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II, application no. 25, columns 5 and 7 can be cloned 3'prime to the transitpeptide encoding sequence, leading to a functional pre-protein, which is directed to the plastids and which means that the mature protein fulfills its biological activity.

for the disclosure of the paragraphs [0228.0.0.24] to [0239.0.0.24] see paragraphs [0228.0.0.0] to [0239.0.0.0] above.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in Table I, application no. 25, columns 5 and 7 or its derivatives, it is advantageous additionally to express and/or mutate further genes in the organisms. Especially advantageously, additionally at least one further gene of the isoprenoid or carotene biosynthetic pathway such as for a carotenoid precursor, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine the sequences shown in Table I, application no. 25, columns 5 and 7 with genes which generally support or enhances to growth or yield of the target organism, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the isoprenoid or beta-carotene metabolism, in particular in synthesis of carotenoids, e.g. beta-carotene or its/their precursor, e.g. isopentyl pyrophosphate (IPP).

Further advantageous nucleic acid sequences which can be expressed in combination with the sequences used in the process and/or the abovementioned biosynthesis genes are the sequences encoding further genes of the beta-carotene biosynthetic pathway, such as the Isopentenyl diphosphate isomerase, Geranylgeranyl diphosphate synthase, Phytoene synthase, Phytoene desaturase, zeta-Carotene desaturase, beta-Cyclase, beta-Hydroxylase and others. These genes can lead to an increased synthesis of the carotenoids, e.g. beta-carotene or its/their precursor, e.g. isopentyl pyrophosphate (IPP), in particular, of the fine chemical indicated in column 6 of any one of Tables I to IV.

In a further advantageous embodiment of the process of the invention, the organisms used in the process are those in which simultaneously a carotenoids, e.g. beta-carotene or its/their precursor, e.g. isopentyl pyrophosphate (IPP), degrading protein is attenuated, in particular by reducing the rate of expression of the corresponding gene.

The respective fine chemical produced can be isolated from the organism by methods with which the skilled worker is familiar. For example, via extraction, salt precipitation, and/or different chromatography methods. The process according to the invention can be conducted batchwise, semibatchwise or continuously. The respective fine chemical produced by this process can be obtained by harvesting the organisms, either from the crop in which they grow, or from the field. This can be done via pressing or extraction of the plant parts.

for the disclosure of the paragraphs [0243.0.0.24] to [0264.0.0.24] see paragraphs [0243.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I, application no. 25, columns 5 and 7 and described herein to achieve an expression in one of said compartments or extracellular.

for the disclosure of the paragraphs [0266.0.0.24] to [0287.0.0.24] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II, application no. 25, columns 5 and 7 or their homologs is functionally linked to a plastidial targeting sequence. A further preferred embodiment of the invention relates to a vector in which a nucleic acid sequence encoding one of the polypeptides shown in table II, application no. 25, columns 5 and 7 or their homologs is functionally linked to a regulatory sequences which permit the expression in plastids.

for the disclosure of the paragraphs [0289.0.0.24] to [0296.0.0.24] see paragraphs [0289.0.0.0] to [0296.0.0.0] above.

Moreover, a native polypeptide conferring the increase of the respective fine chemical in an organism or part thereof can be isolated from cells (e.g., endothelial cells), for example using the antibody of the present invention as described herein, in particular, an antibody against polypeptides as shown in table II, application no. 25, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II, application no. 25, columns 5 and 7 or as coded by the nucleic acid molecule shown in table I, application no. 25, columns 5 and 7 or functional homologues thereof.

In one advantageous embodiment, in the method of the present invention the activity of a polypeptide is increased comprising or consisting of the consensus sequence shown in table IV, application no. 25, columns 7 and in one another embodiment, the present invention relates to a polypeptide comprising or consisting of the consensus sequence shown in table IV, application no. 25, column 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.24] to [0304.0.0.24] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, application no. 25, columns 5 and 7 by one or more amino acids. In one embodiment, polypeptide distinguishes form the sequence shown in table IIA and/or IIB, application no. 25, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table IIA and/or IIB, application no. 25, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table IIA and/or IIB, application no. 25, columns 5 and 7.

for the disclosure of this paragraph see paragraph [0306.0.0.0] above.

In one embodiment, the invention relates to polypeptide conferring an increase of level of the respective fine chemical indicated in Table IIA and/or IIB, application no. 25, column 6 in an organism or part being encoded by the nucleic acid molecule of the invention or used in the process of the invention and having a sequence which distinguishes from the sequence as shown in table IIA and/or IIB, application no. 25, columns 5 and 7 by one or more amino acids. In another embodiment, said polypeptide of the invention does not consist of the sequence shown in table IIA and/or IIB, application no. 25, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB, application no. 25, columns 5 and 7.

In one embodiment, the present invention relates to a polypeptide having the activity of the protein as shown in table IIA and/or IIB, application no. 25, column 3, which distinguishes over the sequence depicted in table IIA and/or IIB, application no. 25, columns 5 and 7 by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%. In a further preferred embodiment the polypeptide of the invention takes the form of a preprotein consisting of a plastidial transitpeptide joint to a polypeptide having the activity of the protein as shown in table IIA and/or IIB, column 3, from which the transitpeptide is preferably cleaved off upon transport of the preprotein into the organelle, for example into the plastid or mitochondria.

for the disclosure of the paragraphs [0309.0.0.24] to [0311.0.0.24] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table II, application no. 25, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB, application no. 25, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB, application no. 25, columns 5 and 7 or which is homologous thereto, as defined above.

Accordingly the polypeptide of the present invention can vary from the sequences shown in table IIA and/or IIB, application no. 25, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB, application no. 25, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II, application no. 25, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II, application no. 25, column 3. Differences shall mean at least one amino acid different from the sequences as shown in table II, application no. 25, column 3, preferably at least 2, 3, 4, 5, 6, 7, 8, 9 or 10 amino acids, more preferably at least 15, 20, 25, 30, 35, 40, 45 or 50 amino acids different from the sequences as shown in table II, application no. 25, column 3. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II, application no. 25, column 3. The nucleic acid molecules and polypeptide molecules of the invention are expressed such that the yield, production, and/or efficiency of production of a desired compound is improved.

Preferably, the compound is a composition comprising the essentially pure fine chemical, i.e. carotenoids, e.g. beta-carotene or its/their precursor, e.g. isopentyl pyrophosphate (IPP), respectively or a recovered or isolated carotenoids, e.g. beta-carotene or its/their precursor, e.g. isopentyl pyrophosphate (IPP), respectively, e.g. in free or in protein- or membrane-bound form.

for the disclosure of the paragraphs [0320.0.0.24] to [0322.0.0.24] see paragraphs [0320.0.0.0] to [0322.0.0.0] above.

In one embodiment, a protein (=polypeptide) as shown in table II, application no. 25, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II, application no. 25, column 3, e.g., a protein which does not confer the activity described herein and which is derived from the same or a different organism.

for the disclosure of the paragraphs [0324.0.0.24] to [0329.0.0.24] see paragraphs [0324.0.0.0] to [0329.0.0.0] above.

In an especially preferred embodiment, the polypeptide according to the invention furthermore also does not have the sequences of those proteins, which are encoded by the sequences shown in table II, application no. 25, columns 5 and 7.

for the disclosure of the paragraphs [0331.0.0.24] to [0346.0.0.24] see paragraphs [0331.0.0.0] to [0346.0.0.0] above.

Accordingly the present invention relates to any cell transgenic for any nucleic acid characterized as part of the invention, e.g. conferring the increase of the respective fine chemical indicated in column 6 of application no. 25 in any one of Tables I to IV in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II, application no. 25, column 3. Due to the above mentioned activity the respective fine chemical content in a cell or an organism is increased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II, application no. 25, column 3 or a protein as shown in table II, application no. 25, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II, application no. 25, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.24] to [0358.0.0.24] see paragraphs [0350.0.0.0] to [0358.0.0.0] above.

Transgenic plants comprising the respective fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The respective fine chemical indicated in column 6 of any one of Tables I to IV, application no. 25, e.g. carotenoids, e.g. beta-carotene or its/their precursor, e.g. isopentyl pyrophosphate (IPP), and being produced in the process according to the invention may, however, also be isolated from the plant and can be isolated by harvesting the plants either from the culture in which they grow or from the field. This can be done for example via expressing, grinding and/or extraction of the plant parts, preferably the plant seeds, plant fruits, plant tubers and the like.

for the disclosure of the paragraphs [0360.0.0.24] to [0362.0.0.24] see paragraphs [0360.0.0.0] to [0362.0.0.0] above.

In this manner, more than 50% by weight, advantageously more than 60% by weight, preferably more than 70% by weight, especially preferably more than 80% by weight, very especially preferably more than 90% by weight, of the respective fine chemical produced in the process can be isolated. The resulting composition or fraction comprising the respective fine chemical can, if appropriate, subsequently be further purified, if desired mixed with other active ingredients such as fatty acids, vitamins, amino acids, carbohydrates, antibiotics, covitamins, antioxidants, carotenoids, and the like, and, if appropriate, formulated.

In one embodiment, the composition is the fine chemical.

The fine chemical indicated in column 6 of application no. 25 in Table I, in particular carotenoids, e.g. beta-carotene or its/their precursor, e.g. isopentyl pyrophosphate (IPP), and being obtained in the process of the invention are suitable as starting material for the synthesis of further products of value. For example, they can be used in combination with each other or alone for the production of pharmaceuticals, foodstuffs, animal feeds or cosmetics. Accordingly, the present invention relates a method for the production of pharmaceuticals, food stuff, animal feeds, nutrients or cosmetics comprising the steps of the process according to the invention, including the isolation of a composition comprising the fine chemical, e.g. carotenoids, e.g. beta-carotene or its/their precursor, e.g. isopentyl pyrophosphate (IPP), or the isolated respective fine chemical produced, if desired, and formulating the product with a pharmaceutical acceptable carrier or formulating the product in a form acceptable for an application in agriculture. A further embodiment according to the invention is the use of the respective fine chemical indicated in application no. 25, Table I, column 6, and being produced in the process or the use of the transgenic organisms in animal feeds, foodstuffs, medicines, food supplements, cosmetics or pharmaceuticals.

for the disclosure of the paragraphs [0366.0.0.24] to [0369.0.0.24] see paragraphs [0366.0.0.0] to [0369.0.0.0] above.

The fermentation broths obtained in this way, containing in particular the respective fine chemical indicated in column 6 of any one of Tables I to IV; application no. 25 or containing mixtures with other compounds, in particular with other vitamins or e.g. with carotenoids, e.g. with astaxanthin, or fatty acids or containing microorganisms or parts of microorganisms, like plastids, normally have a dry matter content of from 7.5 to 25% by weight. The fermentation broth can be processed further. Depending on requirements, the biomass can be separated, such as, for example, by centrifugation, filtration, decantation coagulation/flocculation or a combination of these methods, from the fermentation broth or left completely in it. The fermentation broth can be thickened or concentrated by known methods, such as, for example, with the aid of a rotary evaporator, thin-film evaporator, falling film evaporator, by reverse osmosis or by nano-filtration. This concentrated fermentation broth can then be worked up by extraction, freeze-drying, spray drying, spray granulation or by other processes.

As carotenoids, e.g. beta-carotene or its/their precursor, e.g. isopentyl pyrophosphate (IPP), is often localized in membranes or plastids, in one embodiment it is advantageous to avoid a leaching of the cells when the biomass is isolated entirely or partly by separation methods, such as, for example, centrifugation, filtration, decantation, coagulation/flocculation or a combination of these methods, from the fermentation broth. The dry biomass can directly be added to animal feed, provided the carotenoids, e.g. beta-carotene or its/their precursor, e.g. isopentyl pyrophosphate (IPP), concentration is sufficiently high and no toxic compounds are present. In view of the instability of carotenoids, e.g. beta-carotene or its/their precursor, e.g. isopentyl pyrophosphate (IPP), conditions for drying, e.g. spray or flash-drying, can be mild and can be avoiding oxidation and cis/trans isomerization. For example antioxidants, e.g. BHT, ethoxyquin or other, can be added. In case the carotenoids, e.g. beta-carotene or its/their precursor, e.g. isopentyl pyrophosphate (IPP), concentration in the biomass is to dilute, solvent extraction can be used for their isolation, e.g. with alcohols, ether or other organic solvents, e.g. with methanol, ethanol, aceton, alcoholic potassium hydroxide, glycerol-fenol, liquefied fenol or for example with acids or bases, like trichloroacetatic acid or potassium hydroxide. A wide range of advantageous methods and techniques for the isolation of vitamin E can be found in the state of the art.

Accordingly, it is possible to further purify the produced carotenoids, e.g. beta-carotene or its/their precursor, e.g. isopentyl pyrophosphate (IPP), resp. For this purpose, the product-containing composition, e.g. a total or partial lipid extraction fraction using organic solvents, e.g. as described above, is subjected for example to a saponification to remove triglycerides, partition between e.g. hexane/methanol (separation of non-polar epiphase from more polar hypophasic derivates) and separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

for the disclosure of the paragraphs [0372.0.0.24] to [0376.0.0.24], [0376.1.0.24] and [0377.0.0.24] see paragraphs [0372.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;
(b) identifying the nucleic acid molecules, which hybridize under relaxed stringent conditions with the nucleic acid molecule of the present invention in particular to the nucleic acid molecule sequence shown in table I, application no. 25, columns 5 and 7, preferably in table IB, application no. 25, columns 5 and 7, and, optionally, isolating the full length cDNA clone or complete genomic clone;
(c) introducing the candidate nucleic acid molecules in host cells, preferably in a plant cell or a microorganism, appropriate for producing the respective fine chemical;
(d) expressing the identified nucleic acid molecules in the host cells;
(e) assaying the respective fine chemical level in the host cells; and
(f) identifying the nucleic acid molecule and its gene product which expression confers an increase in the respective fine chemical level in the host cell after expression compared to the wild type.

for the disclosure of the paragraphs [0379.0.0.24] to [0383.0.0.24] see paragraphs [0379.0.0.0] to [0383.0.0.0] above.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased fine chemical production by for example resistance to drugs blocking fine chemical synthesis and looking whether this effect is dependent on the proteins as shown in table II, application no. 25, column 3, e.g. comparing near identical organisms with low and high activity of the proteins as shown in table II, application no. 25, column 3.

for the disclosure of the paragraphs [0385.0.0.24] to [0404.0.0.24] see paragraphs [0385.0.0.0] to [0404.0.0.0] above.

Accordingly, the nucleic acid of the invention, the polypeptide of the invention, the nucleic acid construct of the invention, the organisms, the host cell, the microorgansms, the plant, plant tissue, plant cell, or the part thereof of the invention, the vector of the invention, the agonist identified with the method of the invention, the nucleic acid molecule identified with the method of the present invention, can be used for the production of the respective fine chemical indicated in Column 6, Table I, application no. 25 or for the production of the respective fine chemical and one or more other carotenoids, vitamins or fatty acids. In one embodiment, in the process of the present invention, the produced carotenoids, e.g. beta-carotene or its/their precursor, e.g. isopentyl pyrophosphate (IPP), is used to protect fatty acids against oxidization, e.g. it is in a further step added in a pure form or only partly isolated to a composition comprising fatty acids.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorgansms, the plant, plant tissue, plant cell, or the part thereof of the invention, the vector of the invention, the agonist identified with the method of the invention, the antibody of the present invention, can be used for the reduction of the respective fine chemical in a organism or part thereof, e.g. in a cell.

The nucleic acid molecule of the invention, the vector of the invention or the nucleic acid construct of the invention may also be useful for the production of organisms resistant to inhibitors of the carotenoids, e.g. beta-carotene or its/their precursor, e.g. isopentyl pyrophosphate (IPP), production biosynthesis pathways. In particular, the overexpression of the polypeptide of the present invention may protect an organism such as a microorganism or a plant against inhibitors, which block the carotenoids, e.g. beta-carotene or its/their precursor, e.g. isopentyl pyrophosphate (IPP), in particular the respective fine chemical synthesis in said organism.

As carotenoids, e.g. beta-carotene or its/their precursor, e.g. isopentyl pyrophosphate (IPP), can protect organisms against damages of oxidative stress, especially singlet oxygens, a increased level of the respective fine chemical can protect plants against herbicides which cause the toxic buildup of oxidative compounds, e.g. singlet oxygens. For example, inhibition of the protoporphorineogen oxidase (Protox), an enzyme important in the synthesis of chlorophyll and heme biosynthesis results in the loss of chlorophyll and carotenoids and in leaky membranes; the membrane destruction is due to creation of free oxygen radicals (which is also reported for other classic photosynthetic inhibitor herbicides).

Accordingly, in one embodiment, the increase of the level of the respective fine chemical is used to protect plants against herbicides destroying membranes due to the creation of free oxygen radicals.

Examples of inhibitors or herbicides building up oxidative stress are aryl triazion, e.g. sulfentrazone, carfentrazone; or diphenylethers, e.g. acifluorfen, lactofen, or oxyfluorfen; or N-Phenylphthalimide, e.g. flumiclorac or flumioxazin; substituted ureas, e.g. fluometuron, tebuthiuron, diuron, or linuron; triazines, e.g. atrazine, prometryn, ametryn, metributzin, prometon, simazine, or hexazinone: or uracils, e.g. bromacil or terbacil.

In a further embodiment the present invention relates to the use of the antagonist of the present invention, the plant of the present invention or a part thereof, the microorganism or the host cell of the present invention or a part thereof for the production a cosmetic composition or a pharmaceutical composition. Such a composition has an antioxidative activity, photoprotective activity, can be used to protect, treat or heal the above mentioned diseases, e.g. hypercholesterolemic or cardiovascular diseases, certain cancers, and cataract formation or as immunostimulatory agent.

The carotenoids, e.g. beta-carotene or its/their precursor, e.g. isopentyl pyrophosphate (IPP), can be also used as stabilizer of other colours or oxygen sensitive compounds, like fatty acids, in particular unsaturated fatty acids.

The carotenoids, e.g. beta-carotene or its/their precursor, e.g. isopentyl pyrophosphate (IPP), of the present invention can be further used for coloring cosmetics or feed and food, specially for coloring food by coloring the feed of for example poultry or lobsters.

for the disclosure of the paragraphs [0406.0.0.24] to [0416.0.0.24] see paragraphs [0406.0.0.0] to [0416.0.0.0] above.

An in vivo mutagenesis of organisms such as algae (e.g. *Spongiococcum* sp, e.g. *Spongiococcum exentricum, Chiorella* sp., *Haematococcus, Phaedactylum tricornatum, Volvox* or *Dunaliella*), *Synechocystis* sp. PCC 6803, *Physcometrella patens, Saccharomyces, Mortierella, Escherichia* and others mentioned above, which are beneficial for the production of carotenoids, e.g. beta-carotene or its/their precursor, e.g. isopentyl pyrophosphate (IPP), can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widely used as chemical agents for random in-vitro mutagensis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired fine chemical.

for the disclosure of the paragraphs [0418.0.0.24] to [0435.0.0.24] see paragraphs [0418.0.0.0] to [0435.0.0.0] above.

Carotenoids, e.g. beta-carotene or its/their precursor, e.g. isopentyl pyrophosphate (IPP), production Carotenoids, e.g. beta-carotene or its/their precursor, e.g. isopentyl pyrophosphate (IPP), can be detected advantageously as described in Deli, J. & Molnar, P., Paprika carotenoids: Analysis, isolation, structure elucidation. Curr. Org. Chem. 6, 1197-1219 (2004) or Fraser, P. D., Pinto, M. E., Holloway, D. E. & Bramley, P. M. Technical advance: application of high-performance liquid chromatography with photodiode array detection to the metabolic profiling of plant isoprenoids. Plant J. 24, 551-558 (2000).

for the disclosure of the paragraphs [0437.0.0.24] and [0438.0.0.24] see paragraphs [0437.0.0.0] and [0438.0.0.0] above.

Example 8

Analysis of the Effect of the Nucleic Acid Molecule on the Production of the Respective Fine Chemical Indicated in Table I, Application No. 25, Column 6 for the disclosure of the paragraph [0440.0.0.24] see paragraph [0440.0.0.10] above.

for the disclosure of this paragraph see [0441.0.0.0] above.

Example 9

Purification of the Carotenoids, e.g. Beta-Carotene or Its/Their Precursor, e.g. Isopentyl Pyrophosphate (IPP)

Abbreviations: GC-MS, gas liquid chromatography/mass spectrometry; TLC, thin-layer chromatography.

The unambiguous detection for the presence of carotenoids, e.g. beta-carotene or its/their precursor, e.g. isopentyl pyrophosphate (IPP), can be obtained by analyzing recombinant organisms using analytical standard methods: GC, GC-MS or TLC, as described (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353).

The total vitamin E produced in the organism for example in yeasts used in the inventive process can be analysed for example according to the following procedure:

The material such as yeasts, *E. coli* or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, separation of non-polar epiphase from more polar hypophasic derivatives and chromatography.

Characterization of the Transgenic Plants

In order to confirm that carotenoids, e.g. beta-carotene or its/their precursor, e.g. isopentyl pyrophosphate (IPP), biosynthesis in the transgenic plants is influenced by the expression of the polypeptides described herein, the tocopherol/carotenoids, e.g. beta-carotene or its/their precursor, e.g. isopentyl pyrophosphate (IPP), content in leaves and seeds of the plants transformed with the described constructs (*Arabidopsis thaliana, Brassica napus* and *Nicotiana tabacum*) is analyzed. For this purpose, the transgenic plants are grown in a greenhouse, and plants which express the gene coding for polypeptide of the invention or used in the method of the invention are identified at the Northern level. The tocopherol content or the carotenoids, e.g. beta-carotene or its/their precursor, e.g. isopentyl pyrophosphate (IPP), content in leaves and seeds of these plants is measured. In all, the tocopherol concentration is raised by comparison with untransformed plants.

If required and desired, further chromatography steps with a suitable resin may follow. Advantageously, carotenoids, e.g. beta-carotene or its/their precursor, e.g. isopentyl pyrophosphate (IPP), can be further purified with a so-called RTHPLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

In addition depending on the produced fine chemical purification is also possible with crystallization or distillation. Both methods are well known to a person skilled in the art.

for the disclosure of the paragraph [0445.0.0.24] see paragraph [0450.0.10.10] above.

to [0496.0.0.24] see paragraphs [0446.0.0.0] to [0496.0.0.0] above.

As an alternative, the carotenoids, e.g. beta-carotene or its/their precursor, e.g. isopentyl pyrophosphate (IPP), can be detected advantageously as described in Deli, J. & Molnar, P., Paprika carotenoids: Analysis, isolation, structure elucidation. Curr. Org. Chem. 6, 1197-1219 (2004) or Fraser, P. D., Pinto, M. E., Holloway, D. E. & Bramley, P. M. Technical advance: application of high-performance liquid chromatography with photodiode array detection to the metabolic profiling of plant isoprenoids. Plant J. 24, 551-558 (2000).

The results of the different plant analyses can be seen from the table, which follows:

TABLE VI

| ORF | Metabolite | Method/Analytics | Min.-Value | Max.-Value |
|---|---|---|---|---|
| b0931 | Isopentenyl Pyrophosphate | LC | 1.60 | 2.48 |
| b1868 | Isopentenyl Pyrophosphate | LC | 1.35 | 1.40 |
| b2032 | Isopentenyl Pyrophosphate | LC | 1.40 | 1.68 |
| YLR099C | Isopentenyl Pyrophosphate | LC | 3.18 | 4.51 |
| YPL080C | Isopentenyl Pyrophosphate | LC | 1.50 | 2.46 | for the disclosure of the paragraphs [0499.0.0.24] and [0500.0.0.24] see paragraphs [0499.0.0.0] and [0500.0.0.0] above.

Example 15a

Engineering Ryegrass Plants by Over-expressing b0931 from *E. coli* or Homologs of b0931 from Other Organisms for the disclosure of the paragraphs [0502.0.0.24] to [0508.0.0.24] see paragraphs [0502.0.0.0] to [0508.0.0.0] above.

Example 15b

Engineering Soybean Plants by Over-expressing b0931 from *E. coli* or Homologs of b0931 from Other Organisms for the disclosure of the paragraphs [0510.0.0.24] to [0513.0.0.24] see paragraphs [0510.0.0.0] to [0513.0.0.0] above.

Example 15c

Engineering Corn Plants by Over-Expressing b0931 from *E. coli* or Homologs of b0931 from Other Organisms for the disclosure of the paragraphs [0515.0.0.24] to [0540.0.0.24] see paragraphs [0515.0.0.0] to [0540.0.0.0] above.

Example 15d

Engineering Wheat Plants by Over-Expressing b0931 from *E. coli* or Homologs of b0931 from Other Organisms for the disclosure of the paragraphs [0542.0.0.24] to [0544.0.0.24] see paragraphs [0542.0.0.0] to [0544.0.0.0] above.

Example 15e

Engineering Rapeseed/Canola plants by Over-Expressing b0931 from *E. coli* or Homologs of b0931 from Other Organisms for the disclosure of the paragraphs [0546.0.0.24] to [0549.0.0.24] see paragraphs [0544.0.0.0] to [0549.0.0.0] above.

Example 15f

Engineering Alfalfa Plants by Over-Expressing b0931 from *E. coli* or Homologs of b0931 from Other Organisms for the disclosure of the paragraphs [0551.0.0.24] to [0554.0.0.24] see paragraphs [0551.0.0.0] to [0554.0.0.0] above.

[0554.1.0.24]: % for the disclosure of this paragraph see [0554.2.0.0] above.

for the disclosure of this paragraph see [0555.0.0.0] above.

Process for the Control of the Production of Fine Chemicals

In a further embodiment, the present invention relates to a further process for the production of fine chemicals as defined below and corresponding embodiments as described herein as follows.

The present invention relates further to a process for the production of fine chemical in a microorganism, a plant cell, a plant, a plant tissue or in one or more parts thereof, preferably in plastids. The invention furthermore relates to nucleic acid molecules, polypeptides, nucleic acid constructs, vectors, antibodies, host cells, plant tissue, propagation material, harvested material, plants, microorganisms as well as agricultural compositions and to their use.

Certain products and by-products of naturally-occurring metabolic processes in cells have utility in a wide array of industries, including, but not limited to, the food, feed, cosmetics, health care, and pharmaceutical industries and agriculture. These molecules, collectively termed 'fine chemicals' include molecules such as vitamins for example vitamin A, D, E, K, $B_1$, $B_2$, $B_6$, $B_{12}$, C, pantothenic acid, biotin or folic acid; substances with vitamin-like character for example vitamin F, lipoic acid, ubiquinones, choline, myoinositiol, vitamin U (S-methylmethionine), flavours for example vanillin, coumarin, isoeugenol, eugenol, (R)-carvone, (S)-carvone, menthol, jasmone or farnesol; nutraceuticals for example phytosterols, flavonoids, anthocyanidins, isoflavons or isoprenoids; detergents; fatty acids such as saturated fatty acids, mono unsaturated fatty acids (singular MUFA, plural MUFAS), poly unsaturated fatty acids (singular PUFA, plural PUFAS), waxes or lipids containing said fatty acids; carbohydrates for example cellulose, starch, dextrin, pectin, xanthangum, carrageenan or alginate; sugars for example monosaccharides such as glucose, fructose, manose, sorbose, ribose, ribulose, xylose, xylulose or galactose, disaccharides such as lactose, sucrose, saccharose, maltose, isomaltose or cellobiose, trisaccharides such as raffinose or maltotriose; carboxylic acids for example citric acid, α-ketoglutaric acid, ferulic acid, sinapic acid or lactic acid; carotinoids for example α-carotene, β-carotene, zeaxanthine, lutein, astaxanthine, lycopene, phytoene or phytofluene, amino acids for example lysine, threonine, methionine, tryptophane, phenylalanine, argenine, valine or tyrosine, cofactors for example heme or quinines, enzymes for example lipases, esterases, proteases, amylases, glucosidases etc. and other compounds [as described e.g. in Kuninaka, A. (1996) Nucleotides and related compounds, p. 561-612, in Biotechnology vol. 6, Rehm et al., eds. VCH: Weinheim, in Industial Microbiology and Biotechnology, Demain et al., second edition, ASM Press Washington, D.C. 1999, in Ullmann's Encyclopedia of Industrial Chemistry, vol. A27, Vitamins, p. 443-613 (1996) VCH: Weinheim and Ong, A. S., Niki, E. & Packer, L. (1995) Nutrition, Lipids, Health, and Disease Proceedings of the UNESCO/Confederation of Scientific and Technological Associations in Malaysia, and the Society for Free Radical Research, Asia, held Sept. 1-3, 1994 at Penang, Malaysia, AOCS Press, (1995)), enzymes, and all other chemicals described in Gutcho (1983) Chemicals by Fermentation, Noyes Data Corporation, ISBN: 0818805086 and references contained therein].

Compounds with health promoting properties that can be considered for inclusion into a nutraceutical or a functional food or which are used in food, feed, cosmetics, and pharmaceutical industries and agriculture are, for example, amino acids, carotenoids, saturated and unsaturated fatty acids, carbohydrates, oligosaccharides, fibres, vitamins and precursors, minerals, cofactors, plant secondary metabolites and others. Some of these compounds for example can block or delay the development of cancer and arteriosclerosis.

Carotenoids can scavenge toxic oxygen radicals and function as provitamins. Multiple unsaturated fatty acids may prevent heart and vascular diseases. Oligosaccharides and fibres can bind toxic compounds and may serve as food for, and this way improve the quantity and quality of the intestinal flora. Oligosaccharides and fibres are poorly digestible and are therefore helpful in keeping the dietary energy low.

For the disclosure of this paragraph see [0004.0.0.0] in the event that the fine chemical is methione, threonine, tryptophane, L-leucine, L-isoleucine and/or L-valine, arginine, glutamate, glutamine and/or proline, 5-oxoproline, alanine, aspartic acid, citrulline, glycine, homoserine, phenylalanine, serine and/or tyrosine, see [0004.0.5.5] in the event that the fine chemical is linoleic acid or α-linolenic acid, see [0004.0.7.7] in the event that the fine chemical is stearic acid or palmitic acid, hexadecenoic acid and/or heptadecanoic acid and/or 2-hydroxy-tetracosenoic-acid and/or hexadecadienoic acid and/or octadecenoic acid and/or hexadecatrienoic acid, see [0004.0.9.9] in the event that the fine chemical is vitamin E, see [0004.0.10.10] in the event that the fine chemical is zeaxanthin or β-cryptoxanthin, see [0004.0.11.11] in the event that the fine chemical is lutein, see [0004.0.12.12] in the event that the fine chemicals are sterols, see [0004.0.15.15] in the event that the fine chemical is citramalic acid, glyceric acid, fumaric acid, malic acid, pyruvic acid, succinic acid and/or threonolactone or their salts, amides, thioesters or esters, see [0004.0.17.17] in the event that the fine chemical is Coenzyme Q9 and/or Coenzyme Q10, see [0004.0.18.18] in the event that the fine chemical is ferulic acid or sinapic acid, see [0004.0.19.19] in the event that the fine chemical is myo-inositol, fructose, glucose, UDP-glucose, raffinose and/or starch and/or cellulose in free or bound form, see [0004.0.20.20] in the event that the fine chemical is cerotic acid, lignoceric acid and/or melissic acid in free or bound form, see [0004.0.21.21] in the event that the fine chemical is glycerol and/or glycerol-3-phosphate in free or bound form, see [0004.0.22.22] in the event that the fine chemical is a glycolipids or galactolipid containing galactose, glucose, mannose, rhamnose or xylose, see [0004.0.23.23] in the event that the fine chemical is salicylic acid and/or salicylic acid esters, see [0004.0.24.24] in the event that the fine chemical is carotenoids, e.g. beta-carotene or its/their precursor(s), e.g. isopentyl pyrophosphate (IPP).

For the disclosure of this paragraph see [0005.0.0.0] in the event that the fine chemical is methione, threonine, tryptophane, L-leucine, L-isoleucine and/or L-valine, arginine, glutamate, glutamine and/or proline, 5-oxoproline, alanine, aspartic acid, citrulline, glycine, homoserine, phenylalanine, serine and/or tyrosine, see [0005.0.5.5] in the event that the fine chemical is linoleic acid, α-linolenic acid, stearic acid or palmitic acid, see [0005.0.14.14] in the event that the fine chemical is hexadecenoic acid and/or heptadecanoic acid and/or 2-hydroxy-tetracosenoic-acid and/or hexadecadienoic acid and/or octadecenoic acid and/or hexadecatrienoic acid, see [0005.0.9.9] in the event that the fine chemical is vitamin E, see [0005.0.10.10] in the event that the fine chemical is zeaxanthin or -cryptoxanthin, see [0005.0.11.11] in the event that the fine chemical is lutein, see [0005.0.12.12] in the event that the fine chemicals are sterols, see [0005.0.15.15] in the event that the fine chemical is citramalic acid, glyceric acid, fumaric acid, malic acid, pyruvic acid, succinic acid and/or threonolactone or their salts, amides, thioesters or esters, see [0005.0.17.17] in the event that the fine chemical is Coenzyme Q9 and/or Coenzyme Q10, see [0005.0.18.18] in the event that the fine chemical is ferulic acid or sinapic acid, see [0005.0.19.19] in the event that the fine chemical is myo-inositol, fructose, glucose, UDP-glucose, raffinose and/or starch and/or cellulose in free or bound form, see in the event that the fine chemical is cerotic acid, lignoceric acid and/or melissic acid in free or bound form, see [0005.0.21.21] in the event that the fine chemical is glycerol and/or glycerol-3-phosphate in free or bound form, see [0005.0.22.22] in the event that the fine chemical is a glycolipids or galactolipid containing galactose, glucose, mannose, rhamnose or xylose, see [0005.0.23.23] in the event that the fine chemical is salicylic acid and/or salicylic acid esters, see [0005.0.24.24] in the event that the fine chemical is carotenoids, e.g. beta-carotene or its/their precursor(s), e.g. isopentyl pyrophosphate (IPP).

For the disclosure of this paragraph see [0006.0.0.0] in the event that the fine chemical is methione, threonine, tryptophane, L-leucine, L-isoleucine and/or L-valine, arginine, glutamate, glutamine and/or proline, 5-oxoproline, alanine, aspartic acid, citrulline, glycine, homoserine, phenylalanine, serine and/or tyrosine, see [0006.0.5.5] in the event that the fine chemical is linoleic acid, α-linolenic acid, see [0006.0.7.7] in the event that the fine chemical is stearic acid, see [0006.0.8.8] in the event that the fine chemical is palmitic acid, see [0006.0.14.14] in the event that the fine chemical is hexadecenoic acid and/or heptadecanoic acid and/or 2-hydroxy-tetracosenoic-acid and/or hexadecadienoic acid and/or octadecenoic acid and/or hexadecatrienoic acid, see [0006.0.9.9] in the event that the fine chemical is vitamin E, see [0006.0.10.10] in the event that the fine chemical is zeaxanthin or β-cryptoxanthin, see [0006.0.11.11] in the event that the fine chemical is lutein, see [0006.0.12.12] in the event that the fine chemicals are sterols, see [0006.0.15.15] in the event that the fine chemical is citramalic acid, glyceric acid, fumaric acid, malic acid, pyruvic acid, succinic acid and/or threonolactone or their salts, amides, thioesters or esters, see [0006.0.17.17] in the event that the fine chemical is Coenzyme Q9 and/or Coenzyme Q10, see [0006.0.18.18] in the event that the fine chemical is ferulic acid or sinapic acid, see [0006.0.19.19] in the event that the fine chemical is myo-inositol, fructose, glucose, UDP-glucose, raffinose and/or starch and/or cellulose in free or bound form, see [0006.0.20.20] in the event that the fine chemical is cerotic acid, lignoceric acid and/or melissic acid in free or bound form, see [0006.0.21.21] in the event that the fine chemical is glycerol and/or glycerol-3-phosphate in free or bound form, see [0006.0.22.22] in the event that the fine chemical is a glycolipids or galactolipid containing galactose, glucose, mannose, rhamnose or xylose, see [0006.0.23.23] in the event that the fine chemical is salicylic acid and/or salicylic acid esters, see [0006.0.24.24] in the event that the fine chemical is carotenoids, e.g. beta-carotene or its/their precursor(s), e.g. isopentyl pyrophosphate (IPP).

For the disclosure of this paragraph see [0007.0.0.0] in the event that the fine chemical is methione, threonine, tryptophane, L-leucine, L-isoleucine and/or L-valine, arginine, glutamate, glutamine and/or proline, 5-oxoproline, alanine, aspartic acid, citrulline, glycine, homoserine, phenylalanine, serine and/or tyrosine, see [0007.0.5.5] in the event that the fine chemical is linoleic acid, α-linolenic acid, see [0007.0.7.7] in the event that the fine chemical is stearic acid, see [0007.0.8.8] in the event that the fine chemical is palmitic acid, see [0007.0.14.14] in the event that the fine chemical is hexadecenoic acid and/or heptadecanoic acid and/or 2-hydroxy-tetracosenoic-acid and/or hexadecadienoic acid and/or octadecenoic acid and/or hexadecatrienoic acid, see [0007.0.9.9] in the event that the fine chemical is vitamin E, see [0007.0.10.10] in the event that the fine chemical is zeaxanthin or β-cryptoxanthin, see [0007.0.11.11] in the event that the fine chemical is lutein, see [0007.0.12.12] in the event that the fine chemicals are sterols, see [0007.0.15.15] in the event that the fine chemical is citramalic acid, glyceric acid, fumaric acid, malic acid, pyruvic acid, succinic acid and/or threonolactone or their salts, amides, thioesters or esters, see [0007.0.17.17] in the event that the fine chemical is Coenzyme Q9 and/or Coenzyme Q10, see [0007.0.18.18] in the event that the fine chemical is ferulic acid or sinapic acid, see [0007.0.19.19] in the event that the fine chemical is myo-inositol, fructose, glucose, UDP-glucose, raffinose and/or starch and/or cellulose in free or bound form, see [0007.0.20.20] in the event that the fine chemical is cerotic acid, lignoceric acid and/or melissic acid in free or bound form, see [0007.0.21.21] in the event that the fine chemical is glycerol and/or glycerol-3-phosphate in free or bound form, see [0007.0.22.22] in the event that the fine chemical is a glycolipids or galactolipid containing galactose, glucose, mannose, rhamnose or xylose, see [0007.0.23.23] in the event that the fine chemical is salicylic acid and/or salicylic acid esters, see [0007.0.24.24] in the event that the fine chemical is carotenoids, e.g. beta-carotene or its/their precursor(s), e.g. isopentyl pyrophosphate (IPP).

For the disclosure of this paragraph see [0007.1.0.1] in the event that the fine chemicals is threonine, tryptophane, L-leucine, L-isoleucine and/or L-valine, arginine, glutamate, glutamine and/or proline.

For the disclosure of this paragraph see [0008.0.0.0] in the event that the fine chemical is methione, threonine, tryptophane, L-leucine, L-isoleucine and/or L-valine, arginine, glutamate, glutamine and/or proline, 5-oxoproline, alanine, aspartic acid, citrulline, glycine, homoserine, phenylalanine, serine and/or tyrosine, see [0008.0.5.5] in the event that the fine chemical is linoleic acid, α-linolenic acid, see [0008.0.7.7] in the event that the fine chemical is stearic acid, see [0008.0.8.8] in the event that the fine chemical is palmitic acid, see [0008.0.14.14] in the event that the fine chemical is hexadecenoic acid and/or heptadecanoic acid and/or 2-hydroxy-tetracosenoic-acid and/or hexadecadienoic acid and/or octadecenoic acid and/or hexadecatrienoic acid, see [0008.0.9.9] in the event that the fine chemical is vitamin E, see [0008.0.10.10] in the event that the fine chemical is zeaxanthin or β-cryptoxanthin, see [0008.0.11.11] in the event that the fine chemical is lutein, see [0008.0.12.12] in the event that the fine chemicals are sterols, see [0008.0.15.15] in the event that the fine chemical is citramalic acid, glyceric acid, fumaric acid, malic acid, pyruvic acid, succinic acid and/or threonolactone or their salts, amides, thioesters or esters, see [0008.0.16.16] in the event that the fine chemical is gamma-aminobutyric acid and/or putrescine and/or shikimate, see [0008.0.17.17] in the event that the fine chemical is Coenzyme Q9 and/or Coenzyme Q10, see [0008.0.18.18] in the event that the fine chemical is ferulic acid or sinapic acid, see [0008.0.19.19] in the event that the fine chemical is myo-inositol, fructose, glucose, UDP-glucose, raffinose and/or starch and/or cellulose in free or bound form, see [0008.0.20.20] in the event that the fine chemical is cerotic acid, lignoceric acid and/or melissic acid in free or bound form, see [0008.0.21.21] in the event that the fine chemical is glycerol and/or glycerol-3-phosphate in free or bound form, see [0008.0.22.22] in the event that the fine chemical is a glycolipids or galactolipid containing galactose, glucose, mannose, rhamnose or xylose, see [0008.0.23.23] in the event that the fine chemical is salicylic acid and/or salicylic acid esters, see [0008.0.24.24] in the event that the fine chemical is carotenoids, e.g. beta-carotene or its/their precursor(s), e.g. isopentyl pyrophosphate (IPP).

For the disclosure of this paragraph see [0009.0.0.0] in the event that the fine chemical is methione, see [0009.0.1.1] in the event that the fine chemical is threonine, see [0009.0.2.2] in the event that the fine chemical is tryptophane, see [0009.0.3.3] in the event that the fine chemical is L-leucine, L-isoleucine and/or L-valine, see [0009.0.4.4] in the event that the fine chemical is arginine, glutamate, glutamine and/or proline, see [0009.0.13.13] in the event that the fine chemical is 5-oxoproline, alanine, aspartic acid, citrulline, glycine, homoserine, phenylalanine, serine and/or tyrosine, see [0009.0.5.5] in the event that the fine chemical is linoleic acid, see [0009.0.6.6] in the event that the fine chemical is α-linolenic acid, see [0009.0.7.7] in the event that the fine chemical is stearic acid, see [0009.0.7.8] in the event that the fine chemical is palmitic acid, see [0009.0.14.14] in the event that the fine chemical is hexadecenoic acid and/or heptadecanoic acid and/or 2-hydroxy-tetracosenoic-acid and/or hexadecadienoic acid and/or octadecenoic acid and/or hexadecatrienoic acid, see [0009.0.9.9] in the event that the fine chemical is vitamin E, see [0009.0.10.10] in the event that the fine chemical is zeaxanthin or β-cryptoxanthin, see [0009.0.11.11] in the event that the fine chemical is lutein, see [0009.0.12.12] in the event that the fine chemicals are sterols, see [0009.0.15.15] in the event that the fine chemical is citramalic acid, glyceric acid, fumaric acid, malic acid, pyruvic acid, succinic acid and/or threonolactone or their salts, amides, thioesters or esters, see [0009.0.16.16] in the event that the fine chemical is gamma-aminobutyric acid and/or putrescine and/or shikimate, see [0009.0.17.17] in the event that the fine chemical is Coenzyme Q9 and/or Coenzyme Q10, see [0009.0.18.18] in the event that the fine chemical is ferulic acid or sinapic acid, see [0009.0.19.19] in the event that the fine chemical is myoinositol, fructose, glucose, UDP-glucose, raffinose and/or starch and/or cellulose in free or bound form, see [0009.0.20.20] in the event that the fine chemical is cerotic acid, lignoceric acid and/or melissic acid in free or bound form, see [0009.0.21.21] in the event that the fine chemical is glycerol and/or glycerol-3-phosphate in free or bound form, see [0008.0.22.22] in the event that the fine chemical is a glycolipids or galactolipid containing galactose, glucose, mannose, rhamnose or xylose, see [0009.0.23.23] in the event that the fine chemical is salicylic acid and/or salicylic acid esters, see [0009.0.24.24] in the event that the fine chemical is carotenoids, e.g. beta-carotene or its/their precursor(s), e.g. isopentyl pyrophosphate (IPP).

For the disclosure of this paragraph see [0010.0.0.0] in the event that the fine chemical is methione, see [0010.0.0.1] in the event that the fine chemical is threonine, see [0010.0.0.2] in the event that the fine chemical is tryptophane, see [0010.0.0.3] in the event that the fine chemical is L-leucine, L-isoleucine and/or L-valine, see [0010.0.0.4] in the event that the fine chemical is arginine, glutamate, glutamine and/or proline, see [0010.0.13.13] in the event that the fine chemical is 5-oxoproline, alanine, aspartic acid, citrulline, glycine, homoserine, phenylalanine, serine and/or tyrosine, see [0010.0.5.5] in the event that the fine chemical is linoleic acid, see [0010.0.5.6] in the event that the fine chemical is α-linolenic acid, see [0010.0.7.7] in the event that the fine chemical is stearic acid, see [0009.0.8.8] to [0012.0.8.8] in the event that the fine chemical is palmitic acid, see [0010.0.14.14] in the event that the fine chemical is hexadecenoic acid and/or heptadecanoic acid and/or 2-hydroxy-tetracosenoic-acid and/or hexadecadienoic acid and/or octadecenoic acid and/or hexadecatrienoic acid, see [0010.0.9.9] in the event that the fine chemical is vitamin E, see [0010.0.10.10] in the event that the fine chemical is zeaxanthin or β-cryptoxanthin, see [0010.0.11.11] in the event that the fine chemical is lutein, see [0010.0.12.12] in the event that the fine chemicals are sterols, see [0010.0.15.15] in the event that the fine chemical is citramalic acid, glyceric acid, fumaric acid, malic acid, pyruvic acid, succinic acid and/or threonolactone or their salts, amides, thioesters or esters, see [0010.0.16.16] in the event that the fine chemical is gamma-aminobutyric acid and/or putrescine and/or shikimate, see [0010.0.17.17] in the event that the fine chemical is Coenzyme Q9 and/or Coenzyme Q10, see [0010.0.18.18] in the event that the fine chemical is ferulic acid or sinapic acid, see [0010.0.19.19] in the event that the fine chemical is myo-inositol, fructose, glucose, UDP-glucose, raffinose and/or starch and/or cellulose in free or bound form, see [0010.0.20.20] in the event that the fine chemical is cerotic acid, lignoceric acid and/or melissic acid in free or bound form, see in the event that the fine chemical is glycerol and/or glycerol-3-phosphate in free or bound form, see [0010.0.22.22] in the event that the fine chemical is a glycolipids or galactolipid containing galactose, glucose, mannose, rhamnose or xylose, see [0010.0.23.23] in the event that the fine chemical is salicylic acid and/or salicylic acid esters, see [0010.0.24.24] in the event that the fine chemical is carotenoids, e.g. beta-carotene or its/their precursor(s), e.g. isopentyl pyrophosphate (IPP).

For the disclosure of this paragraph see [0011.0.0.0] in the event that the fine chemical is methione, see [0011.0.0.1] in the event that the fine chemical is threonine, see [0011.0.0.2] in the event that the fine chemical is tryptophane, see [0011.0.0.3] in the event that the fine chemical is L-leucine, L-isoleucine and/or L-valine, see [0011.0.0.4] in the event that the fine chemical is arginine, glutamate, glutamine and/or proline, see [0011.0.13.13] in the event that the fine chemical is 5-oxoproline, alanine, aspartic acid, citrulline, glycine, homoserine, phenylalanine, serine and/or tyrosine, see [0011.0.5.5] in the event that the fine chemical is linoleic acid, see [0010.0.5.6] to [10012.0.5.6] in the event that the fine chemical is α-linolenic acid, see [0010.0.7.7] in the event that the fine chemical is stearic acid, see [0009.0.8.8] to [0012.0.8.8] in the event that the fine chemical is palmitic acid, see [0011.0.14.14] in the event that the fine chemical is hexadecenoic acid and/or heptadecanoic acid and/or 2-hydroxy-tetracosenoic-acid and/or hexadecadienoic acid and/or octadecenoic acid and/or hexadecatrienoic acid, see [0011.0.9.9] in the event that the fine chemical is vitamin E, see [0011.0.10.10] in the event that the fine chemical is zeaxanthin or β-cryptoxanthin, see [0011.0.11.11] in the event that the fine chemical is lutein, see [0011.0.12.12] in the event that the fine chemicals are sterols, see [0011.0.15.15] in the event that the fine chemical is citramalic acid, glyceric acid, fumaric acid, malic acid, pyruvic acid, succinic acid and/or threonolactone or their salts, amides, thioesters or esters, see [0011.0.16.16] in the event that the fine chemical is gamma-aminobutyric acid and/or putrescine and/or shikimate, see [0011.0.17.17] in the event that the fine chemical is Coenzyme Q9 and/or Coenzyme Q10, see [0011.0.18.18] in the event that the fine chemical is ferulic acid or sinapic acid, see [0011.0.19.19] in the event that the fine chemical is myo-inositol, fructose, glucose, UDP-glucose, raffinose and/or starch and/or cellulose in free or bound form, see [0011.0.20.20] in the event that the fine chemical is cerotic acid, lignoceric acid and/or melissic acid in free or bound form, see [0011.0.21.21] in the event that the fine chemical is glycerol and/or glycerol-3-phosphate in free or bound form, see [0011.0.22.22] in the event that the fine chemical is a glycolipids or galactolipid containing galactose, glucose, mannose, rhamnose or xylose, see [0011.0.23.23] in the event that the fine chemical is salicylic acid and/or salicylic acid esters, see [0011.0.24.24] in the event that the fine chemical is carotenoids, e.g. beta-carotene or its/their precursor(s), e.g. isopentyl pyrophosphate (IPP).

Further advantageous properties of the fine chemical of the invention are described above, preferably in the respective paragraphs [0002.0.m.n] to [0011.0.m.n] whereby m and n can be one or more numbers between zero to twenty-four, as disclosed afore.

During the last decade, many millions of hectares have been planted worldwide with transgenic crops. Over 90% of these crops provide transgenically the agronomic properties of herbicide and pest tolerance.

Today genetic engineering of plants and microorganisms intends to make new or improved products. This development enables industry and farmers to produce higher-value products, for food and feed, for medical and for industrial objectives. Further, it is intended and expected to have a high economic impact.

Fine chemicals for nutraceuticals and pharmaceuticals can be produced chemically or biotechnologically by micro-organisms, animal cell cultures, and plants. Plants are one of the new hosts that can serve for the production of recombinant pharmaceuticals.

Microorganisms, plant cells, plants, plant tissues or one or more parts thereof may serve as new hosts for the production of fine chemicals, recombinant nutraceuticals and/or pharmaceuticals. Nutraceuticals and pharmaceuticals can be distinguished at best on the basis of their features, their physiological activity, their effect on the metabolism animals and human beings and their aim.

Nutraceuticals on the one hand aim to maintain or to meliorate the health situation of principally healthy humans or animals. They are compounds that are naturally present in food or are added to foods for daily consumption. Such foods are called 'functional foods' and in the case of animal application: 'functional feed'. They can be supplied with a health claim.

Synonymous to nutraceuticals and belonging to the same field of terminology are 'functional foods', 'designer foods', 'positive nutrition', 'foods with dietary supplements', 'foods with functional ingredients', 'health food', 'dietary food', 'functional food ingredient', etc. Nutraceuticals are understood as a product that can be a single well-defined food-compound with health promoting characteristics, but also as complex foods with such beneficial characteristics. Nutraceuticals may be briefly and meaningless defined as nutritionally or medicinally enhanced foods that provide physiological, medical and/or health benefits, including the prevention and treatment of disease beyond basic nutritional functions. The definition for a functional food formulated by the EU is "foods that have been satisfactorily demonstrated to affect beneficially one or more target functions of the body, beyond adequate nutritional effects, in a way which is relevant to either an improved state of health and well-being, or reduction of the risk to diseases". The terms "functional feed" and "functional crop" are used with similar meanings.

Pharmaceuticals on the other hand aim to cure (human, animal) patients, to mitigate, or to serve in diagnostics. They usually are purified, well defined medicinal and/or therapeutic preparations that have passed the clinical tests and that are supplied with a medicinal claim.

According to the Concerted Action on Functional Food Sciences in Europe (FUFOSE), funded by the EU, a food can be made a functional food by using different approaches:
to eliminate a component known to cause deleterious effects to the consumer (e.g. an allergenic protein), or to increase the concentration of a natural component in food, or to add a component which is not normally present in most foods, but for which beneficial effects have been demonstrated, or to replace a component, usually a macronutrient, the intake of which is usually excessive by a component which has beneficial effects or to improve the bioavailability of, or to modify, food components for which beneficial effects have been demonstrated.

It would be advantageous to have cells, microorganisms or plants which put a combination of metabolites that means fine chemicals at disposal, whereby the combination of the metabolites may be used for inclusion into a nutraceutical or a functional food or feed.

One object of the present invention is to put cells, microorganisms or plants at disposal, which deliver fine chemicals, in proportions to be used as compounds with health promoting properties that can be considered for inclusion into a nutraceutical or a functional food or feed, preferably without disproportional costs and efforts.

It is further object to present process for the control of the production of the fine chemical in a microorganism, a plant cell, a plant, a plant tissue which modifies the content of two or more metabolites simultaneously.

It is generally accepted that a diet consisting of an adequate number of calories and having sufficient levels of vitamins and minerals allows for proper function of the various systems, and is required to maintain a state of good health. In addition, it is well-established that many diseases and undesirable conditions can be prevented, slowed, or even reversed by modifying the subject's dietary intake.

Improving the quality of foodstuffs and animal feeds is an important task of the food-and-feed industry.

This is necessary since certain fine chemicals, for example like some mentioned above amino acids, fatty acids, glycerides, lipids, vitamins, carotenoids, phytosterols, organic compounds, preferably organic acids as disclosed in [0002.0.15.15], [0002.0.16.16], [0002.0.18.18], [0002.0.20.20] and/or [0002.0.23.23], glycerol and derivates, coenzymes, galactolipids and/or carbohydrates, saccharides and/or sugars, which occur in plants are limited with regard to the supply of mammals. Especially advantageous for the quality of foodstuffs and animal feeds is as balanced as possible a metabolite profile since a great excess of one fine chemical above a specific concentration in the food or feed has no further positive effect on the utilization of the nutrition since other fine chemicals suddenly become limiting. A further increase in quality is only possible via addition of further fine chemicals, which are limiting under these conditions.

Currently, the production of recombinant fine chemicals in plants or microorganisms is usually based on the triggered production or increased production of one selected fine chemical.

On the other hand it is known that one and the same gene may have different characteristics and effects, sometimes additional "side effects", the so called pleiotropic effects.

The pleiotropic effect means that one gene may be responsible for the development of several features and characteristics, often unforeseen change of several characteristics in transgene organisms. Therefore, pleiotropic effects may cause various phenomena and processes in organisms, which could lead to phenotypic changes in the organism.

An other object of the present invention is a process for the production of fine chemicals which avoids undesirable side effect as described above and/or which uses these side effects for the production of combinations of fine chemicals in defined ratios.

To ensure a high quality of foods and animal feeds, it is often necessary to add a plurality of fine chemicals in a balanced manner to suit the organism.

Accordingly, there is still a great demand for suitable genes which encode enzymes or proteins which directly or indirectly participate in the biosynthesis of the fine chemicals and make it possible to produce certain of said fine chemicals specifically on an industrial scale without unwanted byproducts forming.

There is also a demand to reduce the concentration or availability of some undesired metabolites or compounds in plants. McElroy (U.S. Pat. No. 6,750,379) for example discloses plants with minor nutritional quality of the host plant to insect pests. The insecticidal activity is conferred by genes that code for enzymes that facilitate the production of compounds that reduce the nutritional quality, for instance genes encoding for lipoxygenases, which have been shown to exhibit anti-nutritional effects on insects and to reduce the nutritional quality of their diet.

In order to reduce byproducts or undesired metabolites methods of recombinant DNA technology are known, which induce a decrease in gene expression, like knock-out, antisenseRNA or post-transcriptional gene silencing (PTGS) used to describe RNAi (RNA interference), co-suppression and quelling, technologies. These techniques are based on the downregulation or inactivation of an endogenous gene. The inactivation takes place through knockout methods by homologous recombination, for instance by the insertion of sequences within a endogenous gene to disrupt it, rendering its protein non-functional, or removing the gene entirely and for the other methods by introducing a homologous transgene in the cells.

Little is known to date on controlling the production of single and/or certain fine chemicals by other methods of recombinant DNA technology, like the overexpression of exogenous genes.

Schomburg et al. (Plant Cell. 2003 January; 15 (1): 151-163) describes the decrease of endogenous Gibberellin levels in tobacco caused by the increased expression of the AtGA2ox7 or AtGA2ox8 gens from *Arabidopsis thaliana* encoding for Gibberellin 2-oxidases.

From a practical standpoint it would be of great advantage to control the production of fine chemicals and preferably certain combination of fine chemicals in an organism such as a microorganism or a plant in order to produce the fine chemicals and preferably certain combination of fine chemicals in an amount which provides optimal growth and health benefit to animals or humans.

It is an object of the present invention to develop an inexpensive process for the production of fine chemicals or specific combination of fine chemicals. This also includes combinations whereby the production of one, two, three, four, five or more fine chemical is increased and/or one, two, three, four, five or more other fine chemical is decreased in order to suit a specific demand like discussed above.

It is a further object of the present invention to provide a process for the control of the production of fine chemicals in a microorganism, a plant cell, a plant, a plant tissue or in one or more parts thereof without the above mentioned disadvantages.

for the disclosure of this paragraph see [0013.0.0.0] above.

Accordingly, in a first embodiment, the invention relates to a process for the production of a fine chemical, whereby the fine chemical is selected from the group as mentioned below. Accordingly, in the present invention, the term "the fine chemical" as used herein relates to at least two compounds selected from the group consisting of the fine chemicals as disclosed herein. Further, the term "the fine chemical" as used herein also relates to compositions comprising the claimed fine chemicals (in the sense of the invention the plural shall include the singular and vice versa).

Accordingly, in a first embodiment, the invention relates to a process for the production of a fine chemical, whereby the fine chemical means two, three, four, five, preferably 6, 7, 8, 9 or 10, more preferably 11, 12, 13, 14, 15, or more fine chemicals selected from the group consisting of the fine chemicals as described above, preferably in the respective paragraphs [0014.0.m.n] to [0017.0.m.n] and [0017.1.m.n] whereby m and n can be one or more numbers between zero to twenty-four, as disclosed therein, especially as disclosed in [0014.0.0.0], [0015.0.0.0], [0016.0.0.0], [0017.0.0.0] and [0017.1.0.0] for methionine, [0014.0.1.1], [0015.0.1.1], [0016.0.1.1], [0017.0.1.1] and [0017.1.1.1] for threonine, [0014.0.2.2], [0015.0.2.2], [0016.0.2.2], [0017.0.2.2] and [0017.1.2.2] for tryptophane, [0014.0.3.3], [0015.0.3.3], [0016.0.3.3], [0017.0.3.3] and [0017.1.3.3] for leucine, isoleucine and/or valine, [0014.0.4.4], [0015.0.4.4], [0016.0.4.4], [0017.0.4.4] and [0017.1.4.4] for arginine, glutamate, glutamine and/or proline, preferably arginine, glutamate, glutamine and/or proline, [0014.0.5.5], [0015.0.5.5], [0016.0.5.5], [0017.0.5.5] and [0017.1.5.5] for linoleic acid and/or triglycerides, lipids, oils and/or fats containing linoleic acid, [0014.0.6.6], [0015.0.6.6], [0016.0.6.6], [0017.0.6.6] and [0017.1.6.6] for α-linolenic acid or triglycerides, lipids, oils or fats containing α-linolenic acid, [0014.0.7.7], [0015.0.7.7], [0016.0.7.7], [0017.0.7.7] and [0017.1.7.7] for stearic acid or triglycerides, lipids, oils or fats containing stearic acid, [0014.0.8.8], [0015.0.8.8], [0016.0.8.8], [0017.0.8.8] and [0017.1.8.8] for palmitic acid or triglycerides, lipids, oils or fats containing palmitic acid, [0014.0.9.9], [0015.0.9.9], [0016.0.9.9], [0017.0.9.9] and [0017.1.9.9] for vitamin E such as its isomers alpha-tocopherol, beta-tocopherol, gamma-tocopherol, delta-tocopherol, alpha-tocotrienol, beta-tocotrienol, gamma-tocotrienol and delta-tocotrienol or its precursor 2,3-Dimethyl-5-phytylquinol,

[0014.0.10.10], [0015.0.10.10], [0016.0.10.10], [0017.0.10.10] and [0017.1.10.10] for xanthopylls, preferably zeaxanthin or β-cryptoxanthin in free form or bound to other compounds such as membrane lipids, [0014.0.11.11], [0015.0.11.11], [0016.0.11.11], [0017.0.11.11] and [0017.1.11.11] for lutein in its free form, its salts, ester, its mono- or diesters of fatty acids, e.g. as lutein dipalmitates, dimyristates or monomyristates or bound to proteins, e.g. lipoproteins or tuberlin, or bound to other compounds, [0014.0.12.12], [0015.0.12.12], [0016.0.12.12], [0017.0.12.12] and [0017.1.12.12] for sterols, preferably phytosterols and ester, thioester or sterols in free form or bound to other compounds, [0014.0.13.13], [0015.0.13.13], [0016.0.13.13], [0017.0.13.13] and [0017.1.13.13] for 5-oxoproline, alanine, aspartic acid, citrulline, glycine, homoserine, phenylalanine, serine and/or tyrosine, and [0017.1.14.14] for hexadecenoic acid, preferably 9-hexadecenoic acid, more preferably trans-9-hexadecenoic acid ((E)-9-Hexadecenoic acid; palmitelaidic acid; trans-9-hexadecenoic acid; trans-palmitoleic acid, CAS Registry No.:10030-73-6) and/or 2-hydroxy palmitic acid (2-OH-C16:0, alfa-hydroxy palmitic acid, C16:0 OH) and/or heptadecanoic acid (C17:0, margaric acid) and/or 2-hydroxy-tetracosenoic-acid, preferably 2-hydroxy-15-tetracosenoic acid (hydroxynervonic acid, alfa-hydroxy-tetracosenoic-acid, C24:1 (n-9) OH, 2-hydroxy-cis 9-tetracosenoic-acid, delta 9 hydroxy-tetracosenoic-acid) and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid (9-Octadecenoic acid, (Z)-; oleic acid) and/or hexadecatrienoic acid, preferably delta 7, 10, 13 hexadecatrienoic acid (C16:3 (n-3), cis 7-cis 10-cis 13-hexadecatrienoic acid, hiragonic acid) or triglycerides, lipids, oils or fats containing hexadecenoic acid, preferably 9-hexadecenoic acid, more preferably trans-9-hexadecenoic acid ((E)-9-Hexadecenoic acid; palmitelaidic acid; trans-9-hexadecenoic acid; trans-palmitoleic acid, CAS Registry No.: 10030-73-6) and/or 2-hydroxy palmitic acid (2-OH-C16:0, alfa-hydroxy palmitic acid, C16:0 OH) and/or heptadecanoic acid (C17:0, margaric acid) and/or 2-hydroxy-tetracosenoic-acid, preferably 2-hydroxy-15-tetracosenoic acid (hydroxynervonic acid, alfa-hydroxy-tetracosenoic-acid, C24:1 (n-9) OH, 2-hydroxy-cis 9-tetracosenoic-acid, delta 9 hydroxy-tetracosenoic-acid) and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid (9-Octadecenoic acid, (Z)-; oleic acid) and/or hexadecatrienoic acid, preferably delta 7, 10, 13 hexadecatrienoic acid (C16:3 (n-3), cis 7-cis 10-cis 13-hexadecatrienoic acid, hiragonic acid), [0014.0.15.15], [0015.0.15.15], [0016.0.15.15], [0017.0.15.15] and [0017.1.15.15] for citramalic acid, glyceric acid, fumaric acid, malic acid, pyruvic acid, succinic acid and/or threonolactone or their salts, amides, thioesters or esters, [0014.0.16.16], [0015.0.16.16], [0016.0.16.16], [0017.0.16.16] and [0017.1.16.16] for gamma-aminobutyric acid and/or putrescine and/or shikimate in free form or bound to other compounds such as its salts, ester, thioester or in free form or bound to other compounds such sugars or sugar polymers, like glucoside, e.g. diglucoside, [0014.0.17.17], [0015.0.17.17], [0016.0.17.17], [0017.0.17.17] and [0017.1.17.17] for Coenzyme Q9, Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, [0014.0.18.18], [0015.0.18.18], [0016.0.18.18], [0017.0.18.18] and [0017.1.18.18] for ferulic acid or sinapic acid, its salts, ester, thioester or in free form or bound to other compounds such sugars or sugar polymers, like glucoside, e.g. diglucoside, [0014.0.19.19], [0015.0.19.19], [0016.0.19.19], [0017.0.19.19] and [0017.1.19.19] for myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, [0014.0.20.20], [0015.0.20.20], [0016.0.20.20], [0017.0.20.20] and [0017.1.20.20] for cerotic acid lignoceric acid or melissic acid or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, [0014.0.21.21], [0015.0.21.21], [0016.0.21.21], [0017.0.21.21] and [0017.1.21.21] for glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugarpolymers, like glucosides or polyols like myo-inositol or mixtures thereof, [0014.0.22.22], [0015.0.22.22], [0016.0.22.22], [0017.0.22.22] and [0017.1.22.22] for glycolipids containing galactose, glucose, mannose, rhamnose or xylose, more preferably a galactolipid containing galactose or glucose, most preferably a galactolipid containing galactose or mixtures thereof in free form or bound to other compounds, [0014.0.23.23], [0015.0.23.23], [0016.0.23.23], [0017.0.23.23] and [0017.1.23.23] for salicylic acid in free form or its salts or its ester or bound in other compounds, [0014.0.24.24], [0015.0.24.24], [0016.0.24.24], [0017.0.24.24] and [0017.1.24.24] for carotenoids, e.g. beta-carotene or its/their precursor, e.g. isopentyl pyrophosphate (IPP);

preferably selected from the group consisting of Methionine, Threonine, Tryptophane, Isoleucine, Leucine, Valine, Arginine, Glutamate, Glutamine, Proline, 5-Oxoproline, Alanine, Aspartic acid, Citrulline, Glycine, Homoserine, Phenylalanine, Serine, Tyrosine, gamma-Aminobutyric acid (GABA), Putrescine, Shikimic Acid, Palmitic acid (C16:0), Linoleic acid (C18:cis[9,12]2), Linolenic acid (C18:cis[9,12,15]3), Stearic acid (C18:0), C20:1 fatty acid (Gadoleic acid), 2-Hydroxy-palmitic acid, Heptadecanoic acid (C17:0), Hexadecadienoic acid (C16:2), Hexadecatrienoic acid (C16:3), C24:1 fatty acid (2-Hydroxy-tetracosenoic acid (2-OH-C24:1)), Behenic acid (C22:0), Cerotic Acid (C26:0), Lignoceric acid (C24:0), Melissic Acid (C30:0), Glycerol, lipid fraction, Glycerol, polar fraction, Glycerol-3-phosphate, 2,3-Dimethyl-5-phytylquinol, alpha-Tocopherol, beta/gamma-Tocopherol, Cryptoxanthin, Zeaxanthin, Lutein, beta-Sitosterol, Cam pesterol, Anhydroglucose (Starch/Cellulose), Fructose, Glucose, iso-Maltose, myo-Inositol, Raffinose, Sucrose, UDPGlucose, Verbascose, Ferulic acid, Sinapic Acid, Threonic acid, Coenzyme Q10, Coenzyme Q9, beta-apo-8 Carotenal, beta-Carotene, Isopentenyl Pyrophosphate, Citramalate, Fumarate, Glyceric acid, Malate, Malate, Lacton of Trihydroxybutyric Acid, Pyruvate, Succinate, Trihydroxybutanoic acid, Salicylic acid, Phosphate (inorganic and from organic phosphates), Methylgalactopyranoside, preferably as shown in table XII and/or XIII.

Accordingly, the present invention relates to a process as described above, preferably in the respective paragraph [0016.0.m.n] whereby m and n can be one or more numbers between zero to twenty-four, as disclosed afore, and conferring a defined metabolite profile.

In one embodiment the present invention relates to a process for the control of the production of the fine chemical comprising (a) increasing or generating the activity of one or more b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039, b4139, YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W protein(s) or of a protein having the sequence of a polypeptide encoded by a corresponding nucleic acid molecule indicated in Table I, columns 5 or 7 or indicated in table VII columns 5 or 7, in the plastid of a microorganism or plant or in one or more parts thereof; and (b) growing the organism under conditions which permit the production of the fine chemical in said organism or in the culture medium.

Advantageously the process confers a defined metabolic profile in the organism as for example disclosed for the under point (a) aforementioned defined genes. Typical profiles are disclosed in table XII and/or XIII.

Accordingly, the present invention relates to a process for the control of the production of fine chemicals comprising
(a) increasing or generating the activity of one or more proteins having the activity of a protein indicated in Table II or Table IX, column 3, preferably as indicated in table XII and/or XIII or having the sequence of a polypeptide encoded by a corresponding nucleic acid molecule indicated in Table I or table VIII, column 5 or 7, in a non-human organism in one or more parts thereof, preferably in an organelle, most preferably in a plastid and
(b) growing the organism under conditions which permit the production of the fine chemicals.

Advantageously the process confers a defined metabolic profile in the organism or in the culture medium surrounding as for example disclosed for the under paragraph [0016.0.25.25] point (a) aforementioned defined genes. Typical profiles are disclosed in table XIII.

Advantagously the activity of the protein as depicted in table II or IX, column 3 encoded by the nucleic acid sequences as depicted in table I or VIII, column 5 is increased or generated in the abovementioned process in the plastid of a microorganism or plant.

for the disclosure of the paragraphs [0019.0.0.25] to [0024.0.0.25] see paragraphs [0019.0.0.0] and [0024.0.0.0] above.

Even more preferred nucleic acid sequences are encoding transit peptides as disclosed by von Heijne et al. [Plant Molecular Biology Reporter, Vol. 9 (2), 1991: 104-126], which are hereby incorporated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences as depicted in table I and VIII, columns 5 and 7. Most preferred nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from genes encoding plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-tranlationally to direct the protein to the plastid preferably to the chloroplast. The nucleic acid sequences encoding such transit peptides are usually localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small n.d. structural flexible amino acids such as glycine or alanine.

As mentioned above the nucleic acid sequences coding for the proteins as shown in table II or IX, column 3 and its homologs as disclosed in table I or VII, columns 5 and 7 are joined to a nucleic acid sequence encoding a transit peptide, This nucleic acid sequence encoding a transit peptide ensures transport of the protein to the plastid. The nucleic acid sequence of the gene to be expressed and the nucleic acid sequence encoding the transit peptide are operably linked. Therefore the transit peptide is fused in frame to the nucleic acid sequence coding for proteins as shown in table II or IX, column 3 or 5 and its homologs as disclosed in table I or VIII, column 7.

for the disclosure of the paragraphs [0027.0.0.25] to [0029.0.0.25] see paragraphs [0027.0.0.0] and [0029.0.0.0] above.

Alternatively, nucleic acid sequences coding for the transit peptides may be chemically synthesized either in part or wholly according to sequence of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence corresponding to the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences depicted in table I or VII, columns 5 and 7. The person skilled in the art is able to join said sequences in a functional manner. Advantageously the transit peptide part is cleaved off from the protein part shown in table II or IX, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein metioned in table II or IX, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein metioned in table II or IX, columns 5 and 7.

In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes metioned in table I or VIII, columns 5 and 7. Furthermore the skilled worker is aware of the fact that there is not a need for such short sequences in the expression of the genes.

Alternatively to the targeting of the sequences as depicted in table II or IX, columns 5 and 7 preferably of sequences in general encoded in the nucleus with the aid of the targeting sequences mentioned for example in table V alone or in combination with other targeting sequences preferably into the plastids, the nucleic acids of the invention can directly introduced into the plastidal genome. Therefore in a preferred embodiment the nucleic acid sequences shown in table I or VIII, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

Table V: Examples of transit peptides disclosed by von Heijne et al. for the disclosure of Table V see paragraph [0030.2.0.0] above.

for the disclosure of the paragraphs [0030.2.0.25] and [0030.3.0.25] see paragraphs [0030.2.0.0] and [0030.3.0.0] above.

For the inventive process it is of great advantage that by transforming the plastids the intraspecies specific transgene flow is blocked, because a lot of species such as corn, cotton and rice have a strict maternal inheritance of plastids. By placing the genes specified in table I or VIII, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I or VIII, columns 5 and 7 or a sequence encoding a protein, as depicted in table II or IX, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C R Acad Sci III. 2001 October; 324(10): 943-52). Viroids usually contain about 200-500 nucleotides and generally exist as circular molecules. Examples of viroids that contain chloroplast localization signals include but are not limeted to ASBVd, PLMVd, CChMVd and ELVd. The viroid sequence or a functional part of it can be fused to the sequences depicted in table I or VIII, columns 5 and 7 or a sequence encoding a protein, as depicted in table II or IX, columns 5 and 7 in such a manner that the viroid sequence transports a sequence transcribed from a sequence as depicted in table I or VIII, columns 5 and 7 or a sequence encoding a protein as depicted in table II or IX, columns 5 and 7 into the chloroplasts. A preferred embodiment uses a modified ASBVd (Navarro et al., Virology. 2000 Mar. 1; 268(1): 218-25).

In a further specific embodiment the protein to be expressed in the plastids such as the proteins depicted in table II or IX, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II or IX, columns 5 and 7.

In a preferred embodiment of the invention the nucleic acid sequences as shown in table I or VIII, columns 5 and 7 used in the inventive process are transformed into plastids, which are metabolical active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I or VII, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

for the disclosure of the paragraphs [0031.0.0.25] and [0032.0.0.25] see paragraphs [0031.0.0.0] and [0032.0.0.0] above.

The corresponding nucleic acid molecule (the terms "nucleic acid molecule", "nucleic acid" or "nucleic acid sequence" are equivalent throughout the specification) of a polypeptide as indicated in II or IX, column 5 is defined in Table I and VIII, column 5, nucleic acid sequence of homologues is defined in table I and VIII, column 7.

For the purposes of the invention, as a rule the term "fine chemical" is intended to encompass the term "metabolite" and vice versa and is intended to compass also the plural as defined above.

The "combination" of fine chemicals according to the invention is defined as a metabolite profile. Metabolite profile means a combination of different fine chemicals in certain ratio, e.g. as disclosed in Table XIII.

The metabolite profile of a cell of the invention is characterized by "increase of a metabolite content" or "decrease of a metabolite content", which relates to the relative increase or decrease of that metabolite content in cell, a microorganism, a plant cell, a plant, a plant tissue or in one or more parts thereof compared to the wild type cell, microorganism, plant cell, plant, plant tissue or one or more parts thereof.

According to the invention, the metabolite profile is expressed by the changes in the metabolite content, e.g. the metabolic profile as indicated in table XIII and/or by the ratio of the fine chemicals as indicated in table XIII.

In other words, the metabolite profile of a cell, a microorganism, a plant cell, a plant, a plant tissue or in one or more parts thereof, which is preferably. transgenic, which has an increased or generated activity of a protein selected from the group consisting of b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039, b4139, YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W, preferably in an organelle, most preferably in a plastid and is defined by the content of the fine chemicals and/or the ratio of the fine chemicals as disclosed in the column beneath the respective protein.

The metabolite profile is characterized by the metabolic content of the fine chemicals of the invention, preferably a combination of 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85 or 86 of the metabolites as shown in table XII and/or XIII, preferably selected from the group consisting of Methionine, Threonine, Tryptophane, Isoleucine, Leucine, Valine, Arginine, Glutamate, Glutamine, Proline, 5-Oxoproline, Alanine, Aspartic acid, Citrulline, Glycine, Homoserine, Phenylalanine, Serine, Tyrosine, gamma-Aminobutyric acid (GABA), Putrescine, Shikimic Acid, Palmitic acid (C16:0), Linoleic acid (C18:cis[9,12]2), Linolenic acid (C18:cis[9,12,15]3), Stearic acid (C18:0), C20:1 fatty acid (Gadoleic acid), 2-Hydroxy-palmitic acid, Heptadecanoic acid (C17:0), Hexadecadienoic acid (C16:2), Hexadecatrienoic acid (C16:3), C24:1 fatty acid (2-Hydroxy-tetracosenoic acid (2-OH-C24:1)), Behenic acid (C22:0), Cerotic Acid (C26:0), Lignoceric acid (C24:0), Melissic Acid (C30:0), Glycerol, lipid fraction, Glycerol, polar fraction, Glycerol-3-phosphate, 2,3-Dimethyl-5-phytylquinol, alpha-Tocopherol, beta/gamma-Tocopherol, Cryptoxanthin, Zeaxanthin, Lutein, beta-Sitosterol, Cam pesterol, An hydroglucose (Starch/Cellulose), Fructose, Glucose, iso-Maltose, myo-Inositol, Raffinose, Sucrose, UDPGlucose, Verbascose, Ferulic acid, Sinapic Acid, Coenzyme Q10, Coenzyme Q9, beta-apo-8 Carotenal, beta-Carotene, Isopentenyl Pyrophosphate, Citramalate, Fumarate, Glyceric acid, Threonic acid, Malate, Malate, Lacton of Trihydroxybutyric Acid, Pyruvate, Succinate, Trihydroxybutanoic acid, Salicylic acid, Phosphate (inorganic and from organic phosphates) and Methylgalactopyranoside.

A metabolite profile according to the present invention is defined preferably by the ratio of concentrations of the fine chemicals of the invention.

According to table XIII the increase of a metabolite content, meaning of the concentration of a fine chemical, is expressed by a numerical value greater than "1". A numerical value of "2" means a duplication of the content of the respective fine chemical compared to the relative metabolite profile of the wild type cell, microorganism, plant cell, plant, plant tissue or one or more parts thereof.

According to table XII and/or XIII the decrease of a metabolite content, meaning of the concentration of a fine chemical, is expressed by a numerical value less than "1". A numerical value of "0.5" means a halving of the content of the respective fine chemical compared to the relative metabolite profile of the wild type cell, microorganism, plant cell, plant, plant tissue or one or more parts thereof.

No number in table XII and/or XIII generally means a numerical value of "1" concerning the metabolite profile, which is essentially identical to the relative metabolite profile of the wild type cell, microorganism, plant cell, plant, plant tissue or one or more parts thereof.

Different from this general rule, for those metabolites which were listed for two different methods (methods LC and GC in column D) only the numerical value for one of the two methods were listed.

Relative metabolite profile means the ratio of the metabolites, preferably directed to the increase and/or decrease, and not to the numerical value, of the metabolite content as defined above.

In a preferred embodiment the relative metabolite profile is 50%, more preferred, 60%, even more preferred 70%, even more preferred 80% or even more preferred 90%, 91%, 92%, 93%, 94%, 95%, 96%, 97%, 98%, 99% similar to a profile as depicted in any one of the columns of table XIII and expressing the protein displayed in the respective column of table XIII or a homolog thereof.

Preferably the relative metabolite profile is identical to the corresponding metabolite profile a indicated in the column of table XIII.

In other words, the numerical value indicated in table XIII expresses the factor, by which the respective metabolite content is changed comparing with the content of the wild type.

Preferably the metabolite content and/or the ratio of the metabolites implies ranges of concentration of every single fine chemical.

This means an increase of a metabolite content expressed by a numerical value greater than one implies an increase of a metabolite content by factor 1.1; 1.2; 1.3; 1.4; 1.5; 1.6; 1.7; 1.8; 1.9; 2; 2.1; 2.2; 2.3; 2.4; 2.5; 2.6; 2.7; 2.8; 2.9; 3; 3.1; 3.2; 3.3; 3.4; 3.5; 3.6; 3.7; 3.8; 3.9; 4; 4.1; 4.2; 4.3; 4.4; 4.5; 4.6; 4.7; 4.8; 4.9; 5; 5.1; 5.2; 5.3; 5.4; 5.5; 5.6; 5.7; 5.8; 5.9; 6; 6.1; 6.2; 6.3; 6.4; 6.5; 6.6; 6.7; 6.8; 6.9; 7; 7.1; 7.2; 7.3; 7.4; 7.5; 7.6; 7.7; 7.8; 7.9; 8; 8.1; 8.2; 8.3; 8.4; 8.5; 8.6; 8.7; 8.8; 8.9; 9; 9.1; 9.2; 9.3; 9.4; 9.5; 9.6; 9.7; 9.8; 9.9; 10; 10.1; 10.2; 10.3; 10.4; 10.5; 10.6; 10.7; 10.8; 10.9; 11; 11.1; 11.2; 11.3; 11.4; 11.5; 11.6; 11.7; 11.8; 11.9; 12; 12.1; 12.2; 12.3; 12.4; 12.5; 12.6; 12.7; 12.8; 12.9; 13; 13.1; 13.2; 13.3; 13.4; 13.5; 13.6; 13.7; 13.8; 13.9; 14; 14.1; 14.2; 14.3; 14.4; 14.5; 14.6; 14.7; 14.8; 14.9; 15; 15.1; 15.2; 15.3; 15.4; 15.5; 15.6; 15.7; 15.8; 15.9; 16; 16.1; 16.2; 16.3; 16.4; 16.5; 16.6; 16.7; 16.8; 16.9; 17; 17.1; 17.2; 17.3; 17.4; 17.5; 17.6; 17.7; 17.8; 17.9; 18; 18.1; 18.2; 18.3; 18.4; 18.5; 18.6; 18.7; 18.8; 18.9; 19; 19.1; 19.2; 19.3; 19.4; 19.5; 19.6; 19.7; 19.8; 19.9; 20; 20.1; 20.2; 20.3; 20.4; 20.5; 20.6; 20.7; 20.8; 20.9; 21; 21.1; 21.2; 21.3; 21.4; 21.5; 21.6; 21.7; 21.8; 21.9; 22; 22.1; 22.2; 22.3; 22.4; 22.5; 22.6; 22.7; 22.8; 22.9; 23; 23.1; 23.2; 23.3; 23.4; 23.5; 23.6; 23.7; 23.8; 23.9; 24; 24.1; 24.2; 24.3; 24.4; 24.5; 24.6; 24.7; 24.8; 24.9; 25; 25.1; 25.2; 25.3; 25.4; 25.5; 25.6; 25.7; 25.8; 25.9; 26; 26.1; 26.2; 26.3; 26.4; 26.5; 26.6; 26.7; 26.8; 26.9; 27; 27.1; 27.2; 27.3; 27.4; 27.5; 27.6; 27.7; 27.8; 27.9; 28; 28.1; 28.2; 28.3; 28.4; 28.5; 28.6; 28.7; 28.8; 28.9; 29;

29.1; 29.2; 29.3; 29.4; 29.5; 29.6; 29.7; 29.8; 29.9; 30; 31; 32; 33; 34; 35; 36; 37; 38; 39; 40; 41; 42; 43; 44; 45; 46; 47; 48; 49; 50; 55; 60; 65; 70; 75; 80; 85; 90; 95; 100 or more preferably by the respective factor as indicated in table XII or more.

This means a decrease of a metabolite content, meaning of the concentration of a fine chemical, expressed by a numerical value less than one implies a decrease of a metabolite content by factor 0.99; 0.98; 0.97; 0.96; 0.95; 0.94; 0.93; 0.92; 0.91; 0.9; 0.89; 0.88; 0.87; 0.86; 0.85; 0.84; 0.83; 0.82; 0.81; 0.8; 0.79; 0.78; 0.77; 0.76; 0.75; 0.74; 0.73; 0.72; 0.71; 0.7; 0.69; 0.68; 0.67; 0.66; 0.65; 0.64; 0.63; 0.62; 0.61; 0.6; 0.59; 0.58; 0.57; 0.56; 0.55; 0.54; 0.53; 0.52; 0.51; 0.5; 0.49; 0.48; 0.47; 0.46; 0.45; 0.44; 0.43; 0.42; 0.41; 0.4; 0.39; 0.38; 0.37; 0.36; 0.35; 0.34; 0.33; 0.32; 0.31; 0.3; 0.29; 0.28; 0.27; 0.26; 0.25; 0.24; 0.23; 0.22; 0.21; 0.2; 0.19; 0.18; 0.17; 0.16; 0.15; 0.14; 0.13; 0.12; 0.11; 0.1; 0.09; 0.08; 0.07; 0.06; 0.05; 0.04; 0.03; 0.02; 0.01 or less;
preferably by the respective factor as indicated in table XIII or less.

In a further embodiment, the invention relates to a process for the control of the production of fine chemicals, whereby the fine chemicals mean one, two, three, four, five or more fine chemicals selected from the group of fine chemicals as described above, preferably in the respective paragraphs [0014.0.m.n] to [0015.0.m.n] whereby m and n can be one or more numbers between zero to twenty-four or as disclosed in paragraph [0014.0.25.25], as disclosed afore; preferably selected from the group consisting of Methionine, Threonine, Tryptophane, Isoleucine, Leucine, Valine, Arginine, Glutamate, Glutamine, Proline, 5-Oxoproline, Alanine, Aspartic acid, Citrulline, Glycine, Homoserine, Phenylalanine, Serine, Tyrosine, gamma-Aminobutyric acid (GABA), Putrescine, Shikimic Acid, Palmitic acid (C16:0), Linoleic acid (C18:cis[9,12]2), Linolenic acid (C18:cis[9,12,15]3), Stearic acid (C18:0), C20:1 fatty acid (Gadoleic acid), 2-Hydroxy-palmitic acid, Heptadecanoic acid (C17:0), Hexadecadienoic acid (C16:2), Hexadecatrienoic acid (C16:3), C24:1 fatty acid (2-Hydroxy-tetracosenoic acid (2-OH-C24:1)), Behenic acid (C22:0), Cerotic Acid (C26:0), Lignoceric acid (C24:0), Melissic Acid (C30:0), Glycerol, lipid fraction, Glycerol, polar fraction, Glycerol-3-phosphate, 2,3-Dimethyl-5-phytylquinol, alpha-Tocopherol, beta/gamma-Tocopherol, Cryptoxanthin, Zeaxanthin, Lutein, beta-Sitosterol, Cam pesterol, Anhydroglucose (Starch/Cellulose), Fructose, Glucose, iso-Maltose, myo-Inositol, Raffinose, Sucrose, UDPGlucose, Ferulic acid, Sinapic Acid, Coenzyme Q10, Coenzyme Q9, beta-apo-8 Carotenal, beta-Carotene, Isopentenyl Pyrophosphate, Citramalate, Fumarate, Glyceric acid, Malate, Malate, Lacton of Trihydroxybutyric Acid, Pyruvate, Succinate, Trihydroxybutanoic acid, Salicylic acid, Phosphate (inorganic and from organic phosphates), Methylgalactopyranoside,
preferably as shown in table XII and/or XII.

Accordingly, the present invention relates to a process for the control of the production of fine chemicals as described above, preferably in the respective paragraph [0016.0.m.n] whereby m and n can be one or more numbers between zero to twenty-five, as disclosed afore, and conferring a defined metabolite profile.

Preferably the present invention relates to a process comprising
(a) increasing or generating the activity of one or more b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039, b4139, YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W protein(s) or of a protein having the sequence of a polypeptide encoded by a corresponding nucleic acid molecule as depicted in Table I and/or VIII columns 5 or 7, in a non-human organism or in one or more parts thereof, preferably in an organelle, more preferably in a plastid; and
(b) growing the organism under conditions which permit the production fine chemicals in defined ratios in said organism resulting in a defined metabolite profile.

Accordingly, the present invention relates to a process for the control of the production of fine chemicals comprising
(a) increasing or generating the activity of one or more proteins having the activity of a protein as depicted in Table II or IX, column 3, preferably as indicated in table XII and/or XIII or having the sequence of a polypeptide encoded by a corresponding nucleic acid molecule indicated in Table I or VIII, column 5 or 7, in a non-human organism in one or more parts thereof and
(b) growing the organism under conditions which permit the control of the production of fine chemicals in defined ratios in said organism resulting in a defined metabolite profile.

The present invention relates further to a process for the production of a biological composition of fine chemicals in a defined ratio, preferably in a relative metabolite profile as indicated in table XII and/or XIII.

In a biological composition according to the present invention, the fine chemicals are biologically synthesized, meaning they were synthesized in a cell, a microorganism, a plant cell, a plant, a plant tissue or in one or more parts thereof.

The present invention relates further to a biological composition of fine chemicals in a defined ratio, preferably in a relative metabolite profile as indicated in table XII and/or XIII, produced by the process of the invention.

This biological composition according to the invention can be one or more cells of the invention, e.g. of crude microorganism, plant cell, plant, plant tissue or one or more parts thereof of the invention, preferably a raw extract or a purified extract of the cells of the invention, e.g. microorganism, plant cell, plant, plant tissue or one or more parts thereof of the invention, which all comprise one, two, three, four, five or more fine chemicals in a relative metabolite profile as indicated in table XII and/or XIII.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein as depicted in table II, column 3. Preferably the modification of the activity of a protein as depicted in table II, column 3 or their combination can be achieved by joining the protein to a transit peptide.

In another preferred embodiment the process for the production of the fine chemical leads to a decreased production of the fine chemical. The terms "decreased", "lower" or "reduced" mean at least a 10%, 20%, 30%, 40% or 50%, preferably at least 60%, 70%, 80%, 90% or 100%, more preferably 150%, 200%, 300%, 400% or 500% lower production of the fine chemical in comparison to the reference as defined below, e.g. that means in comparison to an organism without the aforementioned modification of the activity of a protein as depicted in table IX, column 3. Preferably the modification of the activity of a protein as depicted in table IX, column 3 or their combination can be achieved by joining the protein to a transit peptide.

Surprisingly it was found, that the transgenic expression of the *Escherichia coli* or *Saccaromyces cerevisiae* proteins as depicted in table II, column 3 in plastids of a plant such as *Arabidopsis thaliana* for example through the linkage to at least one targeting sequence for example as mentioned in table V or by transformation into an organelle preferably a plastid conferred an increase in the fine chemical content of the transformed plants.

Surprisingly it was found, that the transgenic expression of the *Escherichia coli* or *Saccaromyces cerevisiae* proteins as depicted in table IX, column 3 in plastids of a plant such as *Arabidopsis thaliana* for example through the linkage to at least one targeting sequence for example as mentioned in table V or by transformation into an organelle preferably a plastid conferred a decrease in the fine chemical content of the transformed plants.

Surprisingly it was found, that the transgenic expression of the *Escherichia coli* or *Saccaromyces cerevisiae* proteins as depicted in table II and IX, column 3 in plastids of a plant such as *Arabidopsis thaliana* for example through the linkage to at least one targeting sequence for example as mentioned in table V or by transformation into an organelle preferably a plastid conferred an increase of certain fine chemicals selected from the group consisting of Methionine, Threonine, Tryptophane, Isoleucine, Leucine, Valine, Arginine, Glutamate, Glutamine, Proline, 5-Oxoproline, Alanine, Aspartic acid, Citrulline, Glycine, Homoserine, Phenylalanine, Serine, Tyrosine, gamma-Aminobutyric acid (GABA), Putrescine, Shikimic Acid, Palmitic acid (C16:0), Linoleic acid (C18:cis[9,12]2), Linolenic acid (C18:cis[9,12,15]3), Stearic acid (C18:0), C20:1 fatty acid (Gadoleic acid), 2-Hydroxy-palmitic acid, Heptadecanoic acid (C17:0), Hexadecadienoic acid (C16:2), Hexadecatrienoic acid (C16:3), C24:1 fatty acid (2-Hydroxy-tetracosenoic acid (2-OH-C24:1)), Behenic acid (C22:0), Cerotic Acid (C26:0), Lignoceric acid (C24:0), Melissic Acid (C30:0), Glycerol, lipid fraction, Glycerol, polar fraction, Glycerol-3-phosphate, 2,3-Dimethyl-5-phytylquinol, alpha-Tocopherol, beta/gamma-Tocopherol, Cryptoxanthin, Zeaxanthin, Lutein, beta-Sitosterol, Campesterol, Anhydroglucose (Starch/Celilulose), Fructose, Glucose, iso-Maltose, myo-Inositol, Raffinose, Sucrose, UDPGlucose, Ferulic acid, Sinapic Acid, Coenzyme Q10, Coenzyme Q9, beta-apo-8 Carotenal, beta-Carotene, Isopentenyl Pyrophosphate, Citramalate, Fumarate, Glyceric acid, Malate, Malate, Lacton of Trihydroxybutyric Acid, Pyruvate, Succinate, Trihydroxybutanoic acid, Salicylic acid, Phosphate (inorganic and from organic phosphates), Methylgalactopyranoside and at the same time a decrease of certain fine chemical selected from the group consisting of Methionine, Threonine, Tryptophane, Isoleucine, Leucine, Valine, Arginine, Glutamate, Glutamine, Proline, 5-Oxoproline, Alanine, Aspartic acid, Citrulline, Glycine, Homoserine, Phenylalanine, Serine, Tyrosine, gamma-Aminobutyric acid (GABA), Putrescine, Shikimic Acid, Palmitic acid (C16:0), Linoleic acid (C18:cis[9,12]2), Linolenic acid (C18:cis[9,12,15]3), Stearic acid (C18:0), C20:1 fatty acid (Gadoleic acid), 2-Hydroxy-palmitic acid, Heptadecanoic acid (C17:0), Hexadecadienoic acid (C16:2), Hexadecatrienoic acid (C16:3), C24:1 fatty acid (2-Hydroxy-tetracosenoic acid (2-OH-C24:1)), Behenic acid (C22:0), Cerotic Acid (C26:0), Lignoceric acid (C24:0), Melissic Acid (C30:0), Glycerol, lipid fraction, Glycerol, polar fraction, Glycerol-3-phosphate, 2,3-Dimethyl-5-phytylquinol, alpha-Tocopherol, beta/gamma-Tocopherol, Cryptoxanthin, Zeaxanthin, Lutein, beta-Sitosterol, Campesterol, Anhydroglucose (Starch/Cellulose), Fructose, Glucose, iso-Maltose, myo-Inositol, Raffinose, Sucrose, UDPGlucose, Ferulic acid, Sinapic Acid, Coenzyme Q10, Coenzyme Q9, beta-apo-8 Carotenal, beta-Carotene, Isopentenyl Pyrophosphate, Citramalate, Fumarate, Glyceric acid, Malate, Malate, Lacton of Trihydroxybutyric Acid, Pyruvate, Succinate, Trihydroxybutanoic acid, Salicylic acid, Phosphate (inorganic and from organic phosphates), Methylgalactopyranoside and thereby a change of the metabolic content of the transformed plants.

for the disclosure of this paragraph see paragraph [0035.0.0.0] above.

According to the invention an extract of fine chemicals is disclosed in paragraphs [0089.0.m.n], [0102.0.m.n], [0113.0.m.n], [0114.0.m.n], [0115.0.m.n], [0242.2.m.n], [0291.0.m.n], [0359.0.m.n], [0370.0.m.n], [0371.0.m.n], [0385.0.m.n], [0427.4.m.n], [0440.0.m.n], [0443.0.m.n], [0444.0.m.n] and/or [0445.0.m.n], whereby m and n can be one or more numbers between zero to twenty-four, as disclosed afore.

Specifically the extraction of fine chemicals is disclosed for amino acids such as methionine, threonine tryptophane, isoleucine, leucine and/or valine, arginine, glutamate, glutamine, proline, 5-oxoproline, alanine, aspartate, citrulline, glycine, homoserine, phenylalanine, serine and/or tyrosine in the paragraphs [0102.0.0.0], [0102.0.1.1], [0102.0.2.2], [0102.0.3.3], [0102.0.4.4], [0115.0.0.0], [0115.0.1.1], [0115.0.2.2], [0115.0.3.3], [0115.0.4.4], [0291.0.0.0], [0291.0.1.1], [0291.0.2.2], [0291.0.3.3], [0291.0.4.4], [0359.0.0.0], [0359.0.1.1], [0359.0.2.2], [0359.0.3.3], [0359.0.4.4], [0385.0.0.0], [0385.0.1.1], [0385.0.2.2], [0385.0.3.3], [0385.0.4.4], [0443.0.0.0], [0443.0.1.1], [0443.0.2.2], [0443.0.3.3], [0443.0.4.4], [0370.0.13.13], for hydrophobic compounds such as fatty acids like linoleic acid or linolenic acid, stearic acid, palmitic acid, 2-hydroxypalmitic acid, heptadecanoic acid, hexadecadienoic acid, nervonic acid, oleic acid and/or trans-9-hexadecenoic acid, cerotic acid, lignoceric acid and/or melissic acid, Vitamin E and its isomers and precursors or xanthopylle such as zeaxanthin, crytoxanthin or lutein, glycolipids such as glycolipids containing galactose, glucose, mannose, rhamnose or xylose, carotenoids such as beta-carotene or its/their precursor, e.g. isopentyl pyrophosphate (IPP) in the paragraphs [0113.0.5.5], [0113.0.9.9], [0113.0.10.10], [0113.0.11.11], [0114.0.5.5], [0114.0.9.9], [0114.0.10.10], [0114.0.11.11], [0115.0.5.5], [0242.0.5.5], [0242.0.9.9], [0242.0.10.10], [0242.0.11.11], [0359.0.5.5], [0359.0.9.9], [0359.0.10.10], [0359.0.11.11], [0370.0.5.5], [0370.0.6.6], [0370.0.7.7], [0370.0.8.8], [0370.0.9.9], [0370.0.10.10], [0370.0.11.11], [0371.0.9.9], [0371.0.10.10], [0371.0.11.11], [0440.0.5.5], [0443.0.5.5], [0443.0.9.9], [0443.0.10.10], [0443.0.11.11], [0427.0.9.9], [0427.0.11.11], [0089.0.12.12], [0100.0.12.12], [0113.0.12.12], [0114.0.12.12], [0242.2.12.12], [0359.0.12.12], [0370.0.12.12], [0371.0.12.12], [0427.0.12.12], [0442.0.12.12], [0370.0.14.14], [0089.0.20.20], [0113.0.20.20], [0114.0.20.20], [0115.0.20.20], [0115.1.20.20], [0115.2.20.20], [0359.0.20.20], [0370.0.20.20], [0371.0.20.20], [0442.0.20.20], [0443.0.20.20], [0444.0.20.20],

[0445.0.20.20], [0089.0.22.22], [0113.0.22.22], [0114.0.22.22], [0115.0.22.22], [0115.1.22.22], [0115.2.22.22], [0359.0.22.22], [0370.0.22.22], [0371.0.22.22], [0442.0.22.22], [0443.0.22.22], [0444.0.22.22], [0445.0.22.22], [0089.0.24.24], [0113.0.24.24], [0114.0.24.24], [0115.0.24.24], [0359.0.24.24], [0370.0.24.24], [0371.0.24.24], [0442.0.24.24], [0443.0.24.24], [0443.1.24.24], [0444.0.24.24], [0445.0.24.24], for organic acids such as citramalate, fumarate, glyceric acic, malate, pyruvate and/or succinate, gamma-aminobutyric acid and/or putrescine and/or shikimate, ferulic acid or sinapic acid, salicylic acid in the paragraphs [0089.0.15.15], [0113.0.15.15], [0114.0.15.15], [0359.0.15.15], [0370.0.15.15], [0371.0.15.15], [0442.0.15.15], [0443.0.15.15], [0444.0.15.15], [0445.0.15.15], [0089.0.16.16], [0113.0.16.16], [0114.0.16.16], [0115.0.16.16], [0115.1.16.16], [0115.2.16.16], [0359.0.16.16], [0370.0.16.16], [0371.0.16.16], [0442.0.16.16], [0443.0.16.16], [0444.0.16.16], [0089.0.18.18], [0113.0.18.18], [0114.0.18.18], [0115.0.18.18], [0359.0.18.18], [0370.0.18.18], [0371.0.18.18], [0427.4.18.18], [0442.0.18.18], [0443.0.18.18], [0444.0.18.18], [0445.0.18.18], [0089.0.23.23], [0113.0.23.23], [0114.0.23.23], [0115.0.23.23], [0359.0.23.23], [0370.0.23.23], [0371.0.23.23], [0442.0.23.23], [0443.0.23.23], [0443.1.23.23], [0444.0.23.23], [0445.0.23.23], for Coenzyme Q9 and Q10 in the paragraphs [0089.0.17.17], [0113.0.17.17], [0114.0.17.17], [0115.0.17.17], [0115.1.17.17], [0115.2.17.17], [0359.0.17.17], [0370.0.17.17], [0371.0.17.17], [0442.0.17.17], [0443.0.17.17], [0444.0.17.17], [0445.0.17.17], for carbohydrates such as anhydroglucose, fructose, glucose, myo-inositiol, raffinose, sucrose and/or UDP-glucose in the paragraphs [0089.0.19.19], [0113.0.19.19], [0114.0.19.19], [0115.0.19.19], [0115.1.19.19], [0115.2.19.19], [0359.0.19.19], [0370.0.19.19], [0371.0.19.19], [0442.0.19.19], [0443.0.19.19], [0444.0.19.19], for polyols such as glycerol and/or glycerol-3-phosphate in the paragraphs [0089.0.21.21], [0113.0.21.21], [0114.0.21.21], [0115.0.21.21], [0115.1.21.21], [0115.2.21.21], [0359.0.21.21], [0370.0.21.21], [0371.0.21.21], [0442.0.21.21], [0443.0.21.21], [0444.0.21.21], [0445.0.21.21], An extraction is further described in Jander et al., Plant Journal (2004), 39, 465-475 or Summer et al., BMC Plant Biology 2005, 5:8.

According to the invention in another embodiment the purification of fine chemicals is disclosed in paragraphs [0089.0.m.n], [0102.0.m.n], [0113.0.m.n], [0114.0.m.n], [0115.0.m.n], [0242.2.m.n], [0291.0.m.n], [0359.0.m.n], [0370.0.m.n], [0371.0.m.n], [0385.0.m.n], [0427.4.m.n], [0440.0.m.n], [0443.0.m.n], [0444.0.m.n] and/or [0445.0.m.n], whereby m and n can be one or more numbers between zero to twenty-four, as disclosed afore.

Specifically the purification of fine chemicals is disclosed for fatty acids such oleic acid, linoleic acid, α-linolenic acid, stearic acid, palmitic acid and/or 2-hydroxypalmitic acid, heptadecanoic acid, hexadecadienoic acid, hexadecatrienoic acid, nervonic acid and/or trans-9-hexadecenoic acid in the paragraphs [0089.0.5.5], [0089.0.6.6], [0089.0.7.7], [0113.0.5.5], [0114.0.5.5], [0115.0.5.5], [0359.0.5.5], [0370.0.5.5], [0370.0.6.6], [0371.0.5.5], [0371.0.6.6], [0371.0.7.7], [0443.0.5.5], [0444.0.5.5], [0445.0.5.5], According to the invention, the biological composition at least one, or two or three or more, relative metabolite profile as depicted in table XII and/or XIII due to the overexpression of at least one of the nucleic acid molecules or its homologues coding for a protein as depicted in table XII and/or IX, columns 5 or 7.

In one embodiment in the process of the invention the activity of the *Escherichia coli* K12 protein b0342 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.4.4], [0037.0.4.4], [0059.0.4.4], [0060.0.4.4], [0036.0.6.6], [0037.0.6.6], [0059.0.6.6], [0060.0.6.6], [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.3.3], [0059.0.4.4], [0059.0.6.6], [0059.0.13.13], [0059.0.19.19], is increased preferably in an organelle, most preferably in a plastid, conferring an increase of a fine chemical, whereby the fine chemical is at least one compound selected from the group consisting of amino acids such as isoleucine, leucine and/or valine, arginine, glutamate, glutamine and/or proline, 5-oxoproline, alanine, aspartic acid, citrulline, glycine, homoserine, phenylalanine, serine and/or tyrosine, fatty acids such as α-linolenic acid or triglycerides, lipids, oils or fats containing δ-linolenic acid, carbohydrates such as myo-inositol, fructose, glucose, UDP-glucose, raffinose and/or starch and/or cellulose or mixtures thereof in free or bound form, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b0403 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.6.6], [0037.0.6.6], [0059.0.6.6], [0060.0.6.6], [0036.0.8.8], [0037.0.8.8], [0059.0.8.8], [0060.0.8.8], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.5.5], [0059.0.6.6], [0059.0.8.8], [0059.0.13.13], is increased, preferably in an organelle, most preferably in a plastid, conferring an increase of a fine chemical, whereby the fine chemical is at least one compound selected from the group consisting of amino acids such as phenylalanine, fatty acids such as palmitic acid, linoleic acid, nervonic and/or α-linolenic acid or triglycerides, lipids, oils or fats containing palmitic acid, linoleic acid, nervonic acid and/or α-linolenic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Escherichia coli* K12 protein b0403 or its homologs i.e. especially preferred for an increased production of fatty acid, polyunsaturated fatty acid or oil production in various plants.

In one embodiment in the process of the invention the activity of the *Escherichia coli* K12 protein b0488 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.8.8], [0037.0.8.8], [0059.0.8.8], [0060.0.8.8], [0036.0.14.14], [0037.0.14.14], [0059.0.14.14], [0060.0.14.14], [0036.0.18.18], [0037.0.18.18], [0059.0.18.18], [0060.0.18.18], e.g. the activity as defined in the respective aforementioned paragraphs [0059.0.m.n] (where m and n can be one or more numbers between 0 to 24), more preferably as disclosed in the paragraphs [0059.0.8.8], [0059.0.14.14], [0059.0.18.18], is increased, preferably in an organelle, most preferably in a plastid, conferring an increase of a fine chemical, whereby the fine chemical is at least one compound selected from the group consisting of, fatty acids such as palmitic acid and/or 2-Hydroxypalmitic acid or triglycerides, lipids, oils or fats containing palmitic acid and/or 2-Hydroxypalmitic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b0488 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.8.8], [0037.0.8.8], [0059.0.8.8], [0060.0.8.8], [0036.0.14.14], [0037.0.14.14], [0059.0.14.14], [0060.0.14.14], [0036.0.18.18], [0037.0.18.18], [0059.0.18.18], [0060.0.18.18], e.g. the activity as defined in the respective aforementioned paragraphs [0059.0.m.n] (where m and n can be one or more numbers between 0 to 24), more preferably as disclosed in the paragraphs [0059.0.8.8], [0059.0.14.14], [0059.0.18.18], is increased, preferably in an organelle, most preferably in a plastid, conferring a decrease of a fine chemical, whereby the fine chemical is at least one compound selected from the group consisting of organic acid preferably of the phenyl-propan metabolism, such as ferulic, sinapic acid or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b0598 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.14.14], [0037.0.14.14], [0059.0.14.14], [0060.0.14.14], [0036.0.19.19], [0037.0.19.19], [0059.0.19.19], [0060.0.19.19], [0036.0.21.21], [0037.0.21.21], [0059.0.21.21], [0060.0.21.21], [0036.0.22.22], [0037.0.22.22], [0059.0.22.22], [0060.0.22.22], e.g. the activity as defined in the respective aforementioned paragraphs [0059.0.m.n] (where m and n can be one or more numbers between 0 to 24), more preferably as disclosed in the paragraphs [0059.0.14.14], [0059.0.19.19], [0059.0.21.21], [0059.0.22.22], is increased, preferably in an organelle, most preferably in a plastid, conferring an increase of a fine chemical, whereby the fine chemical is at least one compound selected from the group consisting of, fatty acids such as palmitic acid and/or 2-Hydroxypalmitic acid or triglycerides, lipids, oils or fats containing palmitic acid and/or 2-Hydroxypalmitic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b0598 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.14.14], [0037.0.14.14], [0059.0.14.14], [0060.0.14.14], [0036.0.19.19], [0037.0.19.19], [0059.0.19.19], [0060.0.19.19], [0036.0.21.21], [0037.0.21.21], [0059.0.21.21], [0060.0.21.21], [0036.0.22.22], [0037.0.22.22], [0059.0.22.22], [0060.0.22.22], e.g. the activity as defined in the respective aforementioned paragraphs [0059.0.m.n] (where m and n can be one or more numbers between 0 to 24), more preferably as disclosed in the paragraphs [0059.0.14.14], [0059.0.19.19], [0059.0.21.21], [0059.0.22.22], is increased, preferably in an organelle, most preferably in a plastid, conferring a decrease of a fine chemical, whereby the fine chemical is at least one compound selected from the group consisting of carbohydrates such as myo-inositol, fructose, glucose, UDP-glucose, raffinose and/or starch and/or cellulose in free or bound form or mixtures thereof glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b0644 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.15.15], [0037.0.15.15], [0059.0.15.15], [0060.0.15.15], [0036.0.18.18], [0037.0.18.18], [0059.0.18.18], [0060.0.18.18], [0036.0.19.19], [0037.0.19.19], [0059.0.19.19], [0060.0.19.19], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.13.13], [0059.0.15.15], [0059.0.18.18], [0059.0.19.19], [0059.0.21.21], is increased, preferably in an organelle, most preferably in a plastid, conferring an increase of a fine chemical, whereby the fine chemical is at least one compound selected from the group consisting of, amino acids such as 5-oxoproline, alanine, aspartic acid, citrulline, glycine, homoserine, phenylalanine, serine and/or tyrosine, organic acid such as citramalic acid, glyceric acid, fumaric acid, malic acid, pyruvic acid, succinic acid and/or threonolactone, feruclic acid, sinapic acid or their salts, amides, thioesters or esters in free form or bound to other compounds such as proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myoinositol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b0644 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.15.15], [0037.0.15.15], [0059.0.15.15], [0060.0.15.15], [0036.0.18.18], [0037.0.18.18], [0059.0.18.18], [0060.0.18.18], [0036.0.19.19], [0037.0.19.19], [0059.0.19.19], [0060.0.19.19], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.13.13], [0059.0.15.15], [0059.0.18.18], [0059.0.19.19], [0059.0.21.21], is increased, preferably in an organelle, most preferably in a plastid, conferring a decrease of a fine chemical, whereby the fine chemical is at least one compound selected from the group consisting amino acids such as 5-oxoproline, alanine, aspartic acid, citrulline, glycine, homoserine, phenylalanine, serine and/or tyrosine, organic acid such as citramalic acid, glyceric acid, fumaric acid, malic acid, pyruvic acid, succinic acid and/or threonolactone, ferulic acid, sinapic acid or their salts, amides, thioesters or esters in free form or bound to other compounds such as proteins, carbohydrates such as glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugarpolymers, like glucosides or polyols like myo-inositol, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b0720 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.14.14], is increased, preferably in an organelle, most preferably in a plastid, conferring an increase of a fine chemical, whereby the fine chemical is at least one compound selected from the group consisting of, fatty acids such as 2-Hydroxy-palmitic acid and/or Nervonic acid or triglycerides, lipids, oils or fats containing Nervonic acid (C24:1) and/or 2-Hydroxypalmitic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b0760 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.1.1], [0059.0.13.13], is increased, preferably in an organelle, most preferably in a plastid, conferring an increase of a fine chemical, whereby the fine chemical is at least one compound selected from the group consisting of amino acids such as threonine, 5-oxoproline, alanine, aspartic acid, citrulline, glycine, homoserine, phenylalanine, serine and/or tyrosine in free or bound form and/or carbohydrates such as myoinositol, fructose, glucose, UDP-glucose, raffinose and/or starch and/or cellulose or mixtures thereof in free form or bound to other compounds such as protein(s) such as enzyme(s), peptide(s), or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b0855 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4],

[0036.0.13.13], [0037.0.13.13], [0059.0.13.13], [0060.0.13.13], [0036.0.18.18], [0037.0.18.18], [0059.0.18.18], [0060.0.18.18], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.4.4], [0059.0.13.13], [0059.0.18.18], [0059.0.21.21], is increased, preferably in an organelle, most preferably in a plastid, conferring an increase of a fine chemical, whereby the fine chemical is at least one compound selected from the group consisting of amino acids such as arginine, glutamate, glutamine and/or proline, preferably L-arginine, L-glutamate, L-glutamine and/or L-proline, its salts, ester or amids in free form or bound to proteins, 5-oxo-proline, alanine, aspartic acid, citrulline, glycine, homoserine, phenylalanine, serine and/or tyrosine, organic acid such as ferulic acid, sinapic acid or their salts, amides, thioesters or esters in free form or bound to other compounds such as proteins, carbohydrates such as glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

Preferably in another embodiment in the process of the invention the activity of the *Escherichia coli* K12 protein b0855 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], [0036.0.13.13], [0037.0.13.13], [0059.0.13.13], [0060.0.13.13], [0036.0.18.18], [0037.0.18.18], [0059.0.18.18], [0060.0.18.18], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.4.4], [0059.0.13.13], [0059.0.18.18], [0059.0.21.21], is increased, preferably in an organelle, most preferably in a plastid, conferring a decrease of a fine chemical, whereby the fine chemical is at least one compound selected from the group consisting amino acids such as 5-oxoproline, alanine, aspartic acid, citrulline, glycine, homoserine, phenylalanine, serine and/or tyrosine, organic acid such as feruclic acid, sinapic acid or their salts, amides, thioesters or esters in free form or bound to other compounds such as proteins, carbohydrates such as glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b0931 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.6.6], [0037.0.6.6], [0059.0.6.6], [0060.0.6.6], [0036.0.12.12], [0037.0.12.12], [0059.0.12.12], [0060.0.12.12], [0036.0.13.13], [0037.0.13.13], [0059.0.13.13], [0060.0.13.13], [0036.0.15.15], [0037.0.15.15], [0059.0.15.15], [0060.0.15.15], [0036.0.18.18], [0037.0.18.18], [0059.0.18.18], [0060.0.18.18], [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.5.5], [0059.0.6.6], [0059.0.12.12], [0059.0.13.13], [0059.0.15.15], [0059.0.18.18], [0059.0.24.24], is increased preferably in an organelle, most preferably in a plastid, conferring an increase of a fine chemical, whereby the fine chemical is at least one compound selected from the group consisting of fatty acids such as α-linolenic acid, or linoleic acid or triglycerides, lipids, oils or fats containing linoleic acid or linoleic acid and/or triglycerides, lipids, oils and/or fats containing linoleic acid, linoleic acid and its salts, ester, thioester or linoleic acid in free form or bound to other compounds such as triglycerides, glycolipids, phospholipids etc., α-linolenic acid, α-linolenic acid and its salts, ester, thioester or a-linolenic acid in free form or bound to other compounds such as triglycerides, glycolipids, phospholipids etc., phytosterols such as beta-sitosterol, sitostanol, stigmasterol, brassicasterol, campestanol, isofucosterol and campesterol, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, organic acids such as citramalic acid, glyceric acid, fumaric acid, malic acid, pyruvic acid, succinic acid and/or threonolactone, ferulic acid or sinapic acid or their salts, amides, thioesters or esters, carotenoids such as beta-carotene or its/their precursor, e.g. "isopentyl pyrophosphate (IPP), or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b0931 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.6.6], [0037.0.6.6], [0059.0.6.6], [0060.0.6.6], [0036.0.12.12], [0037.0.12.12], [0059.0.12.12], [0060.0.12.12], [0036.0.13.13], [0037.0.13.13], [0059.0.13.13], [0060.0.13.13], [0036.0.15.15], [0037.0.15.15], [0059.0.15.15], [0060.0.15.15], [0036.0.18.18], [0037.0.18.18], [0059.0.18.18], [0060.0.18.18], [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.5.5], [0059.0.6.6], [0059.0.12.12], [0059.0.13.13], [0059.0.15.15], [0059.0.18.18], [0059.0.24.24], is increased, preferably in an organelle, most preferably in a plastid, conferring an decrease of a fine chemical, whereby the fine chemical is at least one compound selected from the group consisting amino acids such as 5-oxoproline, alanine, aspartic acid, citrulline, glycine, homoserine, phenylalanine, serine and/or tyrosine, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased. The expression of *Escherichia coli* K12 protein b0931 or its homologs ie especially preferred for an increased production of fatty acid, polyunsatured fatty acid or oil production in various plants.

In one embodiment in the process of the invention the activity of the *Escherichia coli* K12 protein b1046 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.15.15], [0037.0.15.15], [0059.0.15.15], [0060.0.15.15], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.5.5], [0059.0.15.15], [0059.0.19.19], is increased, preferably in an organelle, most preferably in a plastid, conferring an increase of a fine chemical, whereby the fine chemical is at least one compound selected from the group consisting of fatty acids such as linoleic acid and/or triglycerides, lipids, oils and/or fats containing linoleic acid, linoleic acid and its salts, ester, thioester or linoleic acid in free form or bound to other compounds such as triglycerides, glycolipids, phospholipids etc., organic acids such as citramalic acid, glyceric acid, fumaric acid, malic acid, pyruvic acid, succinic acid and/or threonolactone or their salts, amides, thioesters or esters in free form or bound to other compounds such as proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1062 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.4.4], [0037.0.4.4], [0059.0.4.4], [0060.0.4.4], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.1.1], [0059.0.4.4], [0059.0.13.13], is increased, preferably in an organelle, most preferably in a plastid, conferring an increase of a fine chemical, whereby the fine chemical is at least one compound selected from the group consisting of amino acids such as threonine, arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine, its salts, ester or amids in free form or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1095 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.8.8], [0037.0.8.8], [0059.0.8.8], [0060.0.8.8], [0036.0.10.10], [0037.0.10.10], [0059.0.10.10], [0060.0.10.10], [0036.0.14.14], [0037.0.14.14], [0059.0.14.14], [0060.0.14.14], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.8.8], [0059.0.10.10], [0059.0.14.14], [0059.0.19.19], is increased, preferably in an organelle, most preferably in a plastid, conferring an increase of a fine chemical, whereby the fine chemical is at least one compound selected from the group consisting of fatty acids such as palmitic acid or triglycerides, lipids, oils or fats containing palmitic acid, palmitic acid and its salts, ester, thioester or palmitic acid in free form or bound to other compounds such as triglycerides, glycolipids, phospholipids etc., hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, Xanthopylls such as zeaxanthin and/or β-cryptoxanthin in free form or bound to other compounds such as membrane lipids, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1131 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.1.1], [0037.0.1.1], [0059.0.1.1], [0060.0.1.1], [0036.0.4.4], [0037.0.4.4], [0059.0.4.4], [0060.0.4.4], [0036.0.5.5], [0037.0.5.5], [0059.0.5.5], [0060.0.5.5], [0036.0.10.10], [0037.0.10.10], [0059.0.10.10], [0060.0.10.10], [0036.0.13.13], [0037.0.13.13], [0059.0.13.13], [0060.0.13.13], [0036.0.21.21], [0037.0.21.21], [0059.0.21.21], [0060.0.21.21], [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.0.0], [0059.0.1.1], [0059.0.4.4], [0059.0.10.10], [0059.0.13.13], [0059.0.21.21], [0059.0.24.24], is increased, conferring an increase of a fine chemical, whereby the fine chemical is at least one compound selected from the group consisting of amino acids such as methionine, its salts, ester or amids in free form or bound to proteins, threonine, its salts, ester or amids in free form or bound to proteins, arginine, glutamate, glutamine and/or proline, preferably L-arginine, L-glutamate, L-glutamine and/or L-proline in free form or its salts or bound to proteins, fatty acids such as arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, Xanthopylls such as zeaxanthin and/or β-cryptoxanthin in free form or bound to other compounds such as membrane lipids, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugarpolymers, like glucosides or polyols like myo-inositol, carotenoids such as beta-carotene or its/their precursor, e.g. isopentyl pyrophosphate (IPP), or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Escherichia coli* K12 protein b1131 or its homologs, preferably in an organelle, most preferably in a plastid, is especially preferred for an increased production of limiting amino acids in various crop plants for the feed industry.

In one embodiment in the process of the invention the activity of the *Escherichia coli* K12 protein b1136 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.13.13], [0059.0.19.19], is increased, preferably in an organelle, most preferably in a plastid, conferring an increase of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1184 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], e.g. the activity as defined in the respective aforementioned paragraphs [0059.0.m.n] (where m and n can be one or more numbers between 0 to 24), more preferably as disclosed in the paragraphs [0059.0.4.4], is increased, preferably in an organelle, most preferably in a plastid, conferring an increase of a fine chemical, whereby the fine chemical is at least one compound selected from the group consisting of amino acids such as proline, its salts, ester or amids in free form or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b1184 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.15.15], [0037.0.15.15], [0059.0.15.15], [0060.0.15.15], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs

[0059.0.13.13], [0059.0.15.15], [0059.0.19.19], is increased, preferably in an organelle, most preferably in a plastid, conferring a decrease of a fine chemical, whereby the fine chemical is at least one compound selected from the group consisting amino acids such as 5-oxoproline, alanine, aspartic acid, citrulline, glycine, homoserine, phenylalanine, serine and/or tyrosine, their salts, amides, thioesters or esters in free form or bound to other compounds, organic acids such as citramalic acid, glyceric acid, fumaric acid, malic acid, pyruvic acid, succinic acid and/or threonolactone or their salts, amides, thioesters or esters in free form or bound to other compounds such as proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in XIII. Most preferably some of the aforementioned fine chemicals are increased whereas other fine chemicals are decreased.

In one embodiment in the process of the invention the activity of the *Escherichia coli* K12 protein b1223 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.2.2], [0037.0.2.2], [0059.0.2.2], [0060.0.2.2], [0036.0.3.3], [0037.0.3.3], [0059.0.3.3], [0060.0.3.3], [0036.0.4.4], [0037.0.4.4], [0059.0.4.4], [0060.0.4.4], [0036.0.6.6], [0037.0.6.6], [0059.0.6.6], [0060.0.6.6], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.0.0], [0059.0.2.2], [0059.0.3.3], [0059.0.4.4], [0059.0.6.6], [0059.0.13.13], is increased, preferably in an organelle, most preferably in a plastid, conferring an increase of a fine chemical, whereby the fine chemical is at least one compound selected from the group consisting of amino acids such as methionine, its salts, ester or amids in free form or bound to proteins, tryptophane, its salts, ester or amids in free form or bound to proteins, L-leucine, L-isoleucine and/or L-valine, in free form or its salts or bound to proteins, arginine, glutamate, glutamine and/or proline, 5-oxoproline, alanine, aspartic acid, citrulline, glycine, homoserine, phenylalanine, serine and/or tyrosine in free form or its salts or bound to proteins, fatty acids such as o-linolenic acid in free form or bound to other compounds such as triglycerides, glycolipids, phospholipids etc., or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b1223 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.15.15], is increased, preferably in an organelle, most preferably in a plastid, conferring a decrease of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters in free form or bound to other compounds such as proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased. The expression of *Escherichia coli* K12 protein b1223 or its homologs, preferably in an organelle, most preferably in a plastid, is especially preferred for an increased production of limiting amino acids in various crop plants for the feed industry.

In one embodiment in the process of the invention the activity of the *Escherichia coli* K12 protein b1264 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.4.4], [0037.0.4.4], [0059.0.4.4], [0060.0.4.4], [0036.0.13.13], [0037.0.13.13], [0059.0.13.13], [0060.0.13.13], e.g. the activity as defined in the respective aforementioned paragraphs

[0059.0.m.n] (where m and n can be one or more numbers between 0 to 24), more preferably as disclosed in the paragraphs [0059.0.1.1], [0059.0.4.4], [0059.0.13.13], is increased, preferably in an organelle, most preferably in a plastid, conferring an increase of a fine chemical, whereby the fine chemical is at least one compound selected from the group consisting of amino acids such as threonine in free form or its salts or bound to proteins, arginine, glutamate, glutamine and/or proline in free form or its salts or bound to proteins, 5-oxoproline, alanine, aspartic acid, citrulline, glycine, homoserine, phenylalanine, serine and/or tyrosine in free form or its salts or bound to proteins, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1277 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], e.g. the activity as defined in the respective aforementioned paragraphs [0059.0.m.n] (where m and n can be one or more numbers between 0 to 24), more preferably as disclosed in the paragraphs [0059.0.1.1], is increased, preferably in an organelle, most preferably in a plastid, conferring an increase of a fine chemical, whereby the fine chemical is at least one compound selected from the group consisting of amino acids such as threonine, its salts, ester or amids in free form or bound to proteins, tryptophane, its salts, ester or amids in free form or bound to proteins, L-leucine, L-isoleucine and/or L-valine, in free form or its salts or bound to proteins, arginine, glutamate, glutamine and/or praline, 5-oxoproline, alanine, aspartic acid, citrulline, glycine, homoserine, phenylalanine, serine and/or tyrosine in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b1277 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.16.16], [0037.0.16.16], [0059.0.16.16], [0060.0.16.16], [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.16.16], [0059.0.24.24], is increased, preferably in an organelle, most preferably in a plastid, conferring a decrease of a fine chemical, whereby the fine chemical is at least one compound selected from the group consisting of organic acids such as gamma-aminobutyric acid and/or putrescine and/or shikimate in free form or bound to other compounds such as its salts, ester, thioester or in free form or bound to other compounds such sugars or sugar polymers, like glucoside, e.g. diglucoside, carotenoids such as beta-carotene or its/their precursor, e.g. isopentyl pyrophosphate (IPP), or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b1410 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.8.8], [0037.0.8.8], [0059.0.8.8], [0060.0.8.8], [0036.0.12.12], [0037.0.12.12], [0059.0.12.12], [0060.0.12.12], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.8.8], [0059.0.12.12], [0059.0.19.19], is increased, preferably in an organelle, most preferably in a plastid, conferring an increase of a fine chemical, whereby the fine chemical is at least one compound selected from the group consisting of fatty acids such as palmitic acid, in free form or its salts or bound to triglycerides, phytostyrols such as beta-sitosterol, sitostanol, stigmasterol, brassicasterol, campestanol, isofucosterol and campesterol, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1551 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.17.17], [0037.0.17.17], [0059.0.17.17], [0060.0.17.17], e.g. the activity as defined in the respective aforementioned paragraphs [0059.0.m.n] (where m and n can be one or more numbers between 0 to 24), more preferably as disclosed in the paragraphs [0059.0.17.17], is increased, conferring an increase of a fine chemical, whereby the fine chemical is at least one compound selected from the group consisting of coenzymes such as Coenzyme Q9 or Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b1551 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], e.g. the activity as defined in the respective aforementioned paragraphs

[0059.0.m.n] (where m and n can be one or more numbers between 0 to 24), more preferably as disclosed in the paragraphs [0059.0.4.4], is increased, preferably in an organelle, most preferably in a plastid, conferring a decrease of a fine chemical, whereby the fine chemical is at least one compound selected from the group consisting of amino acids such as arginine, glutamate, glutamine and/or proline, its salts, ester or amids in free form or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b1556 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], [0036.0.7.7], [0037.0.7.7], [0059.0.7.7], [0060.0.7.7], [0036.0.12.12], [0037.0.12.12], [0059.0.12.12], [0060.0.12.12], [0036.0.13.13], [0037.0.13.13], [0059.0.13.13], [0060.0.13.13], [0036.0.17.17], [0037.0.17.17], [0059.0.17.17], [0060.0.17.17], [0036.0.13.13], [0037.0.13.13], [0059.0.13.13], [0060.0.13.13], [0036.0.15.15], [0037.0.15.15], [0059.0.15.15], [0060.0.15.15], [0036.0.17.17], [0037.0.17.17], [0059.0.17.17], [0060.0.17.17], [0036.0.18.18], [0037.0.18.18], [0059.0.18.18], [0060.0.18.18], [0036.0.19.19], [0037.0.19.19], [0059.0.19.19], [0060.0.19.19], [0036.0.22.22], [0037.0.22.22], [0059.0.22.22], [0060.0.22.22], e.g. the activity as defined in the respective aforementioned paragraphs [0059.0.m.n] (where m and n can be one or more numbers between 0 to 24), more preferably as disclosed in the paragraphs [0059.0.4.4], [0059.0.7.7], [0059.0.12.12], [0059.0.13.13], [0059.0.17.17], [0059.0.13.13], [0059.0.15.15], [0059.0.17.17], [0059.0.18.18], [0059.0.19.19], [0059.0.22.22], is increased, preferably in an organelle, most preferably in a plastid, conferring an increase of a fine chemical, whereby the fine chemical is at least one compound selected from the group consisting of amino acids arginine, glutamate, glutamine and/or proline, 5-oxoproline, alanine, aspartic acid, citrulline, glycine, homoserine, phenylalanine, serine and/or tyrosine its salts, ester or amids in free form or bound to proteins, fatty acids such as stearic acid, in free form or its salts or bound to triglycerides. Triglycerides, lipids, oils, fats or lipid mixture thereof shall mean any triglyceride, lipid, oil and/or fat containing any bound or free stearic acid for example sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, or as monoacylglyceride, diacylglyceride or triacylglyceride or other fatty acid esters such as acetyl-Coenzyme A thioester, which contain further saturated or unsaturated fatty acids in the fatty acid molecule, phytosterols such as beta-sitosterol, sitostanol, stigmasterol, brassicasterol, campestanol, isofucosterol and campesterol, coenzymes such as Coenzyme Q9 or Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, organic acids such as ferulic acid or sinapic acid, its salts, ester, thioester or in free form or bound to other compounds such sugars or sugar polymers, like glucoside, e.g. diglucoside, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, glycolipids containing galactose, glucose, mannose, rhamnose or xylose, more preferably a galactolipid containing galactose or glucose, most preferably a galactolipid containing galactose or mixtures thereof in free form or bound to other compounds or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b1556 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.16.16], [0037.0.16.16], [0059.0.16.16], [0060.0.16.16], [0036.0.21.21], [0037.0.21.21], [0059.0.21.21], [0060.0.21.21], [0036.0.23.23], [0037.0.23.23], [0059.0.23.23], [0060.0.23.23], e.g. the activity as defined in the respective aforementioned paragraphs [0059.0.m.n] (where m and n can be one or more numbers between 0 to 24), more preferably as disclosed in the paragraphs [0059.0.13.13], [0059.0.16.16], [0059.0.21.21], [0059.0.23.23], is increased, preferably in an organelle, most preferably in a plastid, conferring a decrease of a fine chemical, whereby the fine chemical is at least one compound selected from the group consisting of amino acids such as 5-oxoproline, alanine, aspartic acid, citrulline, glycine, homoserine, phenylalanine, serine and/or tyrosine its salts, ester or amids in free form or bound to proteins, organic acids such as gamma-aminobutyric acid and/or putrescine and/or shikimate salicylic acid in free form or bound to other compounds such as its salts, ester, thioester or in free form or bound to other compounds such sugars or sugar polymers, like glucoside, e.g. diglucoside, carbohydrates such as glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b1625 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.6.6], [0037.0.6.6], [0059.0.6.6], [0060.0.6.6], [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.6.6], [0059.0.14.14], is increased, preferably in an organelle, most preferably in a plastid, conferring an increase of a fine chemical, whereby the fine chemical is at least one compound selected from the group consisting of fatty acids such as α-linolenic acid or triglycerides, lipids, oils or fats containing α-linolenic acid, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1627 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.8.8], [0037.0.8.8], [0059.0.8.8], [0060.0.8.8], [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.8.8], [0059.0.14.14], is increased, preferably in an organelle, most preferably in a plastid, conferring an increase of a fine chemical, whereby the fine chemical is at least one compound selected from the group consisting of fatty acids such as palmitic acid or triglycerides, lipids, oils or fats containing palmitic acid, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1640 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.13.13], is increased, preferably in an organelle, most preferably in a plastid, conferring an increase of a fine chemical, whereby the fine chemical is at least one compound selected from the group consisting of amino acids such as 5-oxoproline, alanine, aspartic acid, citrulline, glycine, homoserine, phenylalanine, serine and/or tyrosine, its salts, ester or amids in free form or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1700 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.7.7], [0037.0.7.7], [0059.0.7.7], [0060.0.7.7], [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.7.7], [0059.0.14.14], is increased, preferably in an organelle, most preferably in a plastid, conferring an increase of a fine chemical, whereby the fine chemical is at least one compound selected from the group consisting of fatty acids such as stearic acid or triglycerides, lipids, oils or fats containing stearic acid, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9- hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1704 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], [0036.0.3.3], [0037.0.3.3], [0059.0.3.3], [0060.0.3.3], [0036.0.4.4], [0037.0.4.4], [0059.0.4.4], [0060.0.4.4], [0036.0.7.7], [0037.0.7.7], [0059.0.7.7], [0060.0.7.7], [0036.0.9.9], [0037.0.9.9], [0059.0.9.9], [0060.0.9.9], [0036.0.12.12], [0037.0.12.12], [0059.0.12.12], [0060.0.12.12], [0036.0.13.13], [0037.0.13.13], [0059.0.13.13], [0060.0.13.13], [0036.0.16.16], [0037.0.16.16], [0059.0.16.16], [0060.0.16.16], [0036.0.17.17], [0037.0.17.17], [0059.0.17.17], [0060.0.17.17], [0036.0.19.19], [0037.0.19.19], [0059.0.19.19], [0060.0.19.19], [0036.0.23.23], [0037.0.23.23], [0059.0.23.23], [0060.0.23.23], e.g. the activity as defined in the respective aforementioned paragraphs [0059.0.m.n] (where m and n can be one or more numbers between 0 to 24), more preferably as disclosed in the paragraphs [0059.0.2.2], [0059.0.3.3], [0059.0.4.4], [0059.0.7.7], [0059.0.9.9], [0059.0.12.12], [0059.0.13.13], [0059.0.16.16], [0059.0.17.17], [0059.0.19.19], [0059.0.23.23], is increased, preferably in an organelle, most preferably in a plastid, conferring an increase of a fine chemical, whereby the fine chemical is at least one compound selected from the group consisting of amino acids tryptophane, isoleucine, leucine and/or valinearginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, fatty acids such stearic acid or triglycerides, lipids, oils or fats containing stearic acid, stearic acid and its salts, ester, thioester or stearic acid in free form or bound to other compounds such as triglycerides, glycolipids, phospholipids etc., vitamin such as vitamin E activity selected from the group alpha-tocopherol, beta-tocopherol, gamma-tocopherol, delta-tocopherol, alpha-atocotrienol, beta-tocotrienol, gamma-tocotrienol and delta-tocotrienol or the Vitamin E precursor 2,3-Dimethyl-5-phytylquinol, phytosterols such as beta-sitosterol, sitostanol, stigmasterol, brassicasterol, campestanol, isofucosterol and campesterol, organic acids such as gamma-aminobutyric acid and/or putrescine and/or shikimate, salicylic acid in free form or bound to other compounds such as its salts, ester, thioester or in free form or bound to other compounds such sugars or sugar polymers, like glucoside, e.g. diglucoside, coenzymes such as Coenzyme Q9 or Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, glycolipids containing galactose, glucose, mannose, rhamnose or xylose, more preferably a galactolipid containing galactose or glucose, most preferably a galactolipid containing galactose or mixtures thereof in free form or bound to other compounds or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

Preferably in another embodiment in the process of the invention the activity of the *Escherichia coli* K12 protein b1704 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.4.4], [0037.0.4.4], [0059.0.4.4], [0060.0.4.4], [0036.0.14.14], [0037.0.14.14], [0059.0.14.14], [0060.0.14.14], [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.3.3], [0059.0.4.4], [0059.0.14.14], [0059.0.15.15], is increased, preferably in an organelle, most preferably in a plastid, conferring an decrease of a fine chemical, whereby the fine chemical is at least one compound selected from the group consisting of amino acids such as leucine, isoleucine and/or valine, preferably L-leucine, L-isoleucine and/or L-valine in free form or its salts or bound to proteins, arginine, glutamate, glutamine and/or proline, preferably L-arginine, L-glutamate, L-glutamine and/or L-proline in free form or its salts or bound to proteins, fatty acids such as hexadecenoic acid, preferably 9-hexadecenoic acid, more preferably trans-9-hexadecenoic acid and/or 2-hydroxy palmitic acid and/or heptadecanoic acid and/or 2-hydroxytetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, organic acids such as citramalic acid, glyceric acid, fumaric acid, malic acid, pyruvic acid, succinic acid and/or threonolactone or their salts, amides, thioesters or esters in free form or bound to other compounds such as proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XII or XIII. Most preferably some of the aforementioned fine chemicals are increased whereas other fine chemicals are decreased. The expression of *Escherichia coli* K12 protein b1704 or its homologs, preferably in an organelle, most preferably in a plastid, is especially preferred for an strongly increased production of different fine chemicals which derive from the shikimate pathway like shikimic acid, tyrosine and phenylalanine in various crop plants.

In one embodiment in the process of the invention the activity of the *Escherichia coli* K12 protein b1732 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], e.g. the activity as defined in the respective aforementioned paragraphs [0059.0.m.n] (where m and n can be one or more numbers between 0 to 24), more preferably as disclosed in the paragraphs [0059.0.15.15], is increased, conferring an increase of a fine chemical, whereby the fine chemical is at least one compound selected from the group consisting of organic acids citramalic acid, glyceric acid, fumaric acid, malic acid, pyruvic acid, succinic acid and/or threonolactone or their salts, amides, thioesters or esters in free form or bound to other compounds such as proteins, or mixtures thereof in free form or bound to other compounds or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b1732 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.9.9], [0037.0.9.9], [0059.0.9.9], [0060.0.9.9], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.9.9], [0059.0.21.21], is increased, preferably in an organelle, most preferably in a plastid, conferring a decrease of a fine chemical, whereby the fine chemical is at least one compound selected from the group consisting of vitamins such as vitamin E activity selected from the group alpha-tocopherol, beta-tocopherol, gamma-tocopherol, delta-tocopherol, alpha-tocotrienol, beta-tocotrienol, gamma-tocotrienol and delta-tocotrienol or the Vitamin E precursor 2,3-Dimethyl-5-phytylquinol, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b1758 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], [0036.0.8.8], [0037.0.8.8], [0059.0.8.8], [0060.0.8.8], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.4.4], [0059.0.8.8], [0059.0.13.13], is increased, preferably in an organelle, most preferably in a plastid, conferring an increase of a fine chemical, whereby the fine chemical is at least one compound selected from the group consisting of amino acids such as arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, fatty acids such as palmitic acid, in free form or its salts or bound to triglycerides. Triglycerides, lipids, oils, fats or lipid mixture thereof shall mean any triglyceride, lipid, oil and/or fat containing any bound or free palmitic acid for example sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, or as monoacylglyceride, diacylglyceride or triacylglyceride or other fatty acid esters such as acetyl-Coenzyme A thioester, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1868 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.16.16], [0037.0.16.16], [0059.0.16.16], [0060.0.16.16], [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.16.16], [0059.0.24.24], is increased, preferably in an organelle, most preferably in a plastid, conferring an increase of a fine chemical, whereby the fine chemical is at least one compound selected from the group consisting of organic acids such as gamma-aminobutyric acid and/or putrescine and/or shikimate in free form or bound to other compounds such as its salts, ester, thioester or in free form or bound to other compounds such sugars or sugar polymers, like glucoside, e.g. diglucoside, carotenoids such as beta-carotene or its/their precursor, e.g. isopentyl pyrophosphate (IPP), or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1933 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.5.5], [0059.0.14.14], is increased, preferably in an organelle, most preferably in a plastid, conferring an increase of a fine chemical, whereby the fine chemical is at least one compound selected from the group consisting of fatty acids such as linoleic acid or triglycerides, lipids, oils or fats containing palmitic acid, linoleic acid and its salts, ester, thioester or palmitic acid in free form or bound to other compounds such as triglycerides, glycolipids, phospholipids etc, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b1980 or its homologs, preferably as indicated in the respective aforementioned paragraphs [0036.0.m.n], [0037.0.m.n], [0059.0.m.n], [0060.0.m.n], (where m and n can be one. or more numbers between 0 to 24), more preferably as disclosed in the paragraphs [0036.0.8.8], [0037.0.8.8], [0059.0.8.8], [0060.0.8.8], [0036.0.14.14], [0037.0.14.14], [0059.0.14.14], [0060.0.14.14], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.8.8], [0059.0.14.14], [0059.0.19.19], is increased, preferably in an organelle, most preferably in a plastid, conferring an increase of a fine chemical, whereby the fine chemical is at least one compound selected from the group consisting of fatty acids such as palmitic acid or triglycerides, lipids, oils or fats containing palmitic acid, palmitic acid and its salts, ester, thioester or palmitic acid in free form or bound to other compounds such as triglycerides, glycolipids, phospholipids etc, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2022 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.10.10], [0037.0.10.10], [0059.0.10.10], [0060.0.10.10], [0036.0.12.12], [0037.0.12.12], [0059.0.12.12], [0060.0.12.12], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.10.10], [0059.0.12.12], [0059.0.21.21], is increased, preferably in an organelle, most preferably in a plastid, conferring an increase of a fine chemical, whereby the fine chemical is at least one compound selected from the group consisting of xanthophylls such as zeaxanthin or β-cryptoxanthin in free form or bound to other compounds such as membrane lipids, phytostyrols such as beta-sitosterol, sitostanol, stigmasterol, brassicasterol, campestanol, isofucosterol and campesterol, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2040 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.4.4], [0037.0.4.4], [0059.0.4.4], [0060.0.4.4], [0036.0.13.13], [0037.0.13.13], [0059.0.13.13], [0060.0.13.13], [0036.0.23.23], [0037.0.23.23], [0059.0.23.23], [0060.0.23.23], e.g. the activity as defined in the respective aforementioned paragraphs [0059.0.m.n] (where m and n can be one or more numbers between 0 to 24), more preferably as disclosed in the paragraphs [0059.0.1.1], [0059.0.4.4], [0059.0.13.13], [0059.0.23.23], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, organic acids such as salicylic acid in free form or its salts or its ester or bound, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2066 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.3.3], [0037.0.3.3], [0059.0.3.3], [0060.0.3.3], [0036.0.8.8], [0037.0.8.8], [0059.0.8.8], [0060.0.8.8], [0036.0.13.13], [0037.0.13.13], [0059.0.13.13], [0060.0.13.13], [0036.0.15.15], [0037.0.15.15], [0059.0.15.15], [0060.0.15.15], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.1.1], [0059.0.3.3], [0059.0.8.8], [0059.0.13.13], [0059.0.15.15], [0059.0.19.19], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, leucine, isoleucine and/or valine, preferably L-leucine, L-isoleucine and/or L-valine in free form or its salts or bound to proteins, 5-oxoproline, alanine, aspartic acid, citrulline, glycine, homoserine, phenylalanine, serine and/or tyrosine in free form or its salts or bound to proteins, fatty acids such as palmitic acid or triglycerides, lipids, oils or fats containing palmitic acid, palmitic acid and its salts, ester, thioester or palmitic acid in free form or bound to other compounds such as triglycerides, glycolipids, phospholipids etc., organic acids such as citramalic acid, glyceric acid, fumaric acid, malic acid, pyruvic acid, succinic acid and/or threonolactone or their salts, amides, thioesters or esters in free form or bound to other compounds such as proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Escherichia coli* K12 protein b2066 or its homologs, preferably in an organelle, most preferably in a plastid, is especially preferred for an increased production of limiting amino acids in various crop plants for the feed industry.

In one embodiment in the process of the invention the activity of the *Escherichia coli* K12 protein b2223 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.8.8], [0037.0.8.8], [0059.0.8.8], [0060.0.8.8], [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.8.8], [0059.0.13.13], [0059.0.19.19], is increased, preferably in an organelle, most preferably in a plastid, conferring an increase of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, fatty acids such as palmitic acid or triglycerides, lipids, oils or fats containing palmitic acid, palmitic acid and its salts, ester, thioester or palmitic acid in free form or bound to other compounds such as triglycerides, glycolipids, phospholipids etc., carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2284 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.14.14], [0037.0.14.14], [0059.0.14.14], [0060.0.14.14], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs

[0059.0.14.14], [0059.0.19.19], is increased, preferably in an organelle, most preferably in a plastid, conferring an increase of a fine chemical, whereby the fine chemical is at least one compound selected from the group consisting of fatty acids such as hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7,10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxytetracosenoic-acid, preferably 2-hydroxy-15-tetrasenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid and its salts, ester, thioester or palmitic acid in free form or bound to other compounds such as triglycerides, glycolipids, phospholipids etc., carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2312 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs

[0059.0.13.13], [0059.0.15.15], is increased, preferably in an organelle, most preferably in a plastid, conferring an increase of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, organic acids such as citramalic acid, glyceric acid, fumaric acid, malic acid, pyruvic acid, succinic acid and/or threonolactone or their salts, amides, thioesters or esters in free form or bound to other compounds such as proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2344 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.10.10], [0037.0.10.10], [0059.0.10.10], [0060.0.10.10], [0036.0.11.11], [0037.0.11.11], [0059.0.11.11], [0060.0.11.11], e.g. the activity as defined in the respective aforementioned paragraphs [0059.0.m.n] (where m and n can be one or more numbers between 0 to 24), more preferably as disclosed in the paragraphs

[0059.0.10.10], [0059.0.11.11], is increased, preferably in an organelle, most preferably in a plastid, conferring an increase of a fine chemical, whereby the fine chemical is at least one compound selected from the group consisting of xanthophylls such as zeaxanthin, β-cryptoxanthin in free form or bound to other compounds such as membrane lipids, lutein in its free form, its salts, ester, its mono- or diesters of fatty acids, e.g. as lutein dipalmitates, dimyristates or monomyristates or bound to proteins, e.g. lipoproteins or tuberlin, or bound to other compounds, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2366 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.13.13], is increased, preferably in an organelle, most preferably in a plastid, conferring an increase of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2600 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.9.9], [0037.0.9.9], [0059.0.9.9], [0060.0.9.9], [0036.0.13.13], [0037.0.13.13], [0059.0.13.13], [0060.0.13.13], [0036.0.16.16], [0037.0.16.16], [0059.0.16.16], [0060.0.16.16], [0036.0.17.17],

[0037.0.17.17], [0059.0.17.17], [0060.0.17.17], e.g. the activity as defined in the respective aforementioned paragraphs

[0059.0.m.n] (where m and n can be one or more numbers between 0 to 24), more preferably as disclosed in the paragraphs [0059.0.9.9], [0059.0.13.13], [0059.0.16.16], [0059.0.17.17], is increased, preferably in an organelle, most preferably in a plastid, conferring an increase of a fine chemical, whereby the fine chemical is at least one compound selected from the group consisting of vitamines such as vitamin E activity selected from the group alpha-tocopherol, beta-tocopherol, gamma-tocopherol, delta-tocopherol, alpha-tocotrienol, beta-tocotrienol, gamma-tocotrienol and delta-tocotrienol or the Vitamin E precursor 2,3-Dimethyl-5-phytylquinol, amino acids such as 5-oxoproline, alanine, aspartic acid, citrulline, glycine, homoserine, phenylalanine, serine and/or tyrosine in free form or its salts or bound to proteins, organic acids such as gamma-aminobutyric acid and/or putrescine and/or shikimate, in free form or bound to other compounds such as its salts, ester, thioester or in free form or bound to other compounds such sugars or sugar polymers, like glucoside, e.g. diglucoside, coenzymes such as Coenzyme Q9 or Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b2600 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], e.g. the activity as defined in the respective aforementioned paragraphs [0059.0.m.n] (where m and n can be one or more numbers between 0 to 24), more preferably as disclosed in the paragraphs [0059.0.2.2], is increased, preferably in an organelle, most preferably in a plastid, conferring a decrease of a fine chemical, whereby the fine chemical is at least one compound selected from the group consisting of amino acids such as tryptophane, preferably L-tryptophane, its salts, ester or amids in free form or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased. The expression of *Escherichia coli* K12 protein b2600 or its homologs, preferably in an organelle, most preferably in a plastic, is especially preferred for an increased production of plant or microbial derived food, feed or material with an high antioxidative potential.

In one embodiment in the process of the invention the activity of the *Escherichia coli* K12 protein b2601 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], [0036.0.9.9], [0037.0.9.9], [0059.0.9.9], [0060.0.9.9], [0036.0.13.13], [0037.0.13.13], [0059.0.13.13], [0060.0.13.13], [0036.0.16.16], [0037.0.16.16], [0059.0.16.16], [0060.0.16.16], e.g. the activity as defined in the respective aforementioned paragraphs [0059.0.m.n] (where m and n can be one or more numbers between 0 to 24), more preferably as disclosed in the paragraphs [0059.0.2.2], [0059.0.9.9], [0059.0.13.13], [0059.0.16.16], is increased, preferably in an organelle, most preferably in a plastid, conferring an increase of a fine chemical, whereby the fine chemical is at least one compound selected from the group consisting of amino acids such as tryptophane, preferably L-tryptophane, 5-oxoproline, alanine, aspartic acid, citrulline, glycine, homoserine, phenylalanine, serine and/or tyrosine in free form or its salts or bound to proteins, vitamins such as vitamin E selected from the group alpha-tocopherol, beta-tocopherol, gamma-tocopherol, delta-tocopherol, alpha-tocotrienol, beta-tocotrienol, gamma-tocotrienol and delta-tocotrienol or its precursor 2,3-Dimethyl-5-phytylquinol, organic acids such as gamma-aminobutyric acid and/or putrescine and/or shikimate in free form or bound to other compounds such as its salts, ester, thioester or in free form or bound to other compounds such sugars or sugar polymers, like glucoside, e.g. diglucoside, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Escherichia coli* K12 protein b1704 or its homologs, preferably in an organelle, most preferably in a plastid, is especially preferred for an strongly increased production of different fine chemicals which derive from the shikimate pathway like shikimic acid, tyrosine and phenylalanine but also vitamin E in various crop plants.

In one embodiment in the process of the invention the activity of the *Escherichia coli* K12 protein b2818 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], [0036.0.13.13], [0037.0.13.13], [0059.0.13.13], [0060.0.13.13], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.4.4], [0059.0.13.13], [0059.0.21.21], is increased, preferably in an organelle, most preferably in a plastid, conferring an increase of a fine chemical, whereby the fine chemical is at least one compound selected from the group consisting of amino acids such as isoleucine, leucine and/or valine, arginine, glutamate, glutamine and/or proline, 5-oxoproline, alanine, aspartic acid, citrulline, glycine, homoserine, phenylalanine, serine and/or tyrosine, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b2827 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.6.6], [0037.0.6.6], [0059.0.6.6], [0060.0.6.6], [0036.0.7.7], [0037.0.7.7], [0059.0.7.7], [0060.0.7.7], [0036.0.8.8], [0037.0.8.8], [0059.0.8.8], [0060.0.8.8], [0036.0.14.14], [0037.0.14.14], [0059.0.14.14], [0060.0.14.14], [0036.0.19.19], [0037.0.19.19], [0059.0.19.19], [0060.0.19.19], [0036.0.21.21], [0037.0.21.21], [0059.0.21.21], [0060.0.21.21], [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.0.0], [0059.0.6.6], [0059.0.7.7], [0059.0.8.8], [0059.0.14.14], [0059.0.19.19], [0059.0.21.21], [0059.0.24.24], is increased, preferably in an organelle, most preferably in a plastid, conferring an increase of a fine chemical, whereby the fine chemical is at least one compound selected from the group consisting of amino acids such as methionine, preferably L-methionine in free form or its salts or bound to proteins, fatty acids such as α-linolenic acid or triglycerides, lipids, oils or fats containing a-linolenic acid, stearic acid or triglycerides, lipids, oils or fats containing stearic acid, palmitic acid or triglycerides, lipids, oils or fats containing palmitic acid, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7,10,13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7,10,13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans9-hexadecenoic acid and/or 2-hydroxy palmitic acid and/or heptadecanoic acid and/or 2-hydroxy-tetra-cosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7,10,13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid in free form or bound to other compounds such as triglycerides, glycolipids, phospholipids etc., carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, carotenoids such as beta-carotene or its/their precursor, preferably isopentyl pyrophosphate (IPP), or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Escherichia coli* K12 protein b0931 or its homologs i.e. especially preferred for an increased production of fatty acid, polyunsaturated fatty acid or oil production in various plants.

In one embodiment in the process of the invention the activity of the *Escherichia coli* K12 protein b2965 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], [0036.0.3.3], [0037.0.3.3], [0059.0.3.3], [0060.0.3.3], [0036.0.4.4], [0037.0.4.4], [0059.0.4.4], [0060.0.4.4], [0036.0.9.9], [0037.0.9.9], [0059.0.9.9], [0060.0.9.9], [0036.0.13.13], [0037.0.13.13], [0059.0.13.13], [0060.0.13.13], [0036.0.16.16], [0037.0.16.16], [0059.0.16.16], [0060.0.16.16], [0036.0.17.17], [0037.0.17.17], [0059.0.17.17], [0060.0.17.17], [0036.0.19.19], [0037.0.19.19], [0059.0.19.19], [0060.0.19.19], [0036.0.20.20], [0037.0.20.20], [0059.0.20.20], [0060.0.20.20], e.g. the activity as defined in the respective aforementioned paragraphs [0059.0.m.n] (where m and n can be one or more numbers between 0 to 24), more preferably as disclosed in the paragraphs [0059.0.2.2], [0059.0.3.3], [0059.0.4.4], [0059.0.9.9], [0059.0.13.13], [0059.0.16.16], [0059.0.17.17], [0059.0.19.19], [0059.0.20.20], is increased, preferably in an organelle, most preferably in a plastid, conferring an increase of a fine chemical, whereby the fine chemical is at least one compound selected from the group consisting of amino acids tryptophane, isoleucine, leucine and/or valine, arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, vitamines such as vitamin E selected from the group alpha-tocopherol, beta-tocopherol, gamma-tocopherol, delta-tocopherol, alpha-tocotrienol, beta-tocotrienol, gamma-tocotrienol and delta-tocotrienol or its precursor 2,3-Dimethyl-5-phytylquinol, organic acids such as gamma-aminobutyric acid and/or putrescine and/or shikimate, in free form or bound to other compounds such as its salts, ester, thioester or in free form or bound to other compounds such sugars or sugar polymers, like glucoside, e.g. diglucoside, coenzymes such as Coenzyme Q9 or Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, fatty acids such as cerotic acid, lignoceric acid, behenic acid or melissic acid or mixtures thereof in free or bound form, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b2965 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.7.7], [0037.0.7.7], [0059.0.7.7], [0060.0.7.7], [0036.0.12.12], [0037.0.12.12], [0059.0.12.12], [0060.0.12.12], [0036.0.13.13], [0037.0.13.13], [0059.0.13.13], [0060.0.13.13], [0036.0.15.15], [0037.0.15.15], [0059.0.15.15], [0060.0.15.15], [0036.0.16.16], [0037.0.16.16], [0059.0.16.16], [0060.0.16.16], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.1.1], [0059.0.7.7], [0059.0.12.12], [0059.0.13.13], [0059.0.15.15], [0059.0.16.16], [0059.0.19.19], is increased, preferably in an organelle, most preferably in a plastid, conferring a decrease of a fine chemical, whereby the fine chemical is at least one compound selected from the group consisting of amino acids such as threonine, preferably L-threonine in free form or its salts or bound to proteins, 5-oxoproline, alanine, aspartic acid, citrulline, glycine, homoserine, phenylalanine, serine and/or tyrosine in free form or its salts or bound to proteins, fatty acids such as stearic acid or triglycerides, lipids, oils or fats containing stearic acid, phytostyrols such as beta-sitosterol, sitostanol, stigmasterol, brassicasterol, campestanol, isofucosterol and campesterol, organic acids such as citramalic acid, glyceric acid, fumaric acid, malic acid, pyruvic acid, succinic acid and/or threonolactone or their salts, amides, thioesters or esters in free form or bound to other compounds such as proteins, gamma-aminobutyric acid and/or putrescine and/or shikimate in free form or bound to other compounds such as its salts, ester, thioester or in free form or bound to other compounds such sugars or sugar polymers, like glucoside, e.g. diglucoside, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table r XIII. Most preferably some of the aforementioned fine chemicals are increased whereas other fine chemicals are decreased.

In one embodiment in the process of the invention the activity of the *Escherichia coli* K12 protein b3117 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.3.3], [0059.0.13.13], is increased, preferably in an organelle, most preferably in a plastid, conferring an increase of a fine chemical, whereby the fine chemical is at least one compound selected from the group consisting of amino acids such as leucine, isoleucine and/or valine, preferably L-leucine, L-isoleucine and/or L-valine, 5-oxoproline, alanine, aspartic acid, citrulline, glycine, homoserine, phenylalanine, serine and/or tyrosine, in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b3213 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.1.1], [0059.0.13.13], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, 5-oxoproline, alanine, aspartic acid, citrulline, glycine, homoserine, phenylalanine, serine and/or tyrosine, in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b3390 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], [0036.0.9.9], [0037.0.9.9], [0059.0.9.9], [0060.0.9.9], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.2.2], [0059.0.9.9], [0059.0.13.13], is increased, conferring an increase of a fine chemical, whereby the fine chemical is at least one compound selected from the group consisting of amino acids such as tryptophane, preferably L-tryptophane, its salts, ester or amids in free form or bound to proteins, 5-oxoproline, alanine, aspartic acid, citrulline, glycine, homoserine, phenylalanine, serine and/or tyrosine, in free form or its salts or bound to proteins, vitamines such as vitamin E selected from the group alpha-tocopherol, beta-tocopherol, gamma-tocopherol, delta-tocopherol, alpha-tocotrienol, beta-tocotrienol, gamma-tocotrienol and delta-tocotrienol or its precursor 2,3-Dimethyl-5-phytylquinol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b3429 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.6.6], [0037.0.6.6], [0059.0.6.6], [0060.0.6.6], [0036.0.13.13], [0037.0.13.13], [0059.0.13.13], [0060.0.13.13], [0036.0.14.14], [0037.0.14.14], [0059.0.14.14], [0060.0.14.14], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.1.1], [0059.0.6.6], [0059.0.13.13], [0059.0.14.14], [0059.0.21.21], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, 5-oxoproline, alanine, aspartic acid, citrulline, glycine, homoserine, phenylalanine, serine and/or tyrosine, in free form or its salts or bound to proteins, fatty acids such as α-linolenic acid or triglycerides, lipids, oils or fats containing α-linolenic acid, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acidin free form or bound to other compounds such as triglycerides, glycolipids, phospholipids etc., glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b3443 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.4.4], [0037.0.4.4], [0059.0.4.4], [0060.0.4.4], e.g. the activity as defined in the respective aforementioned paragraphs [0059.0.m.n] (where m and n can be one or more numbers between 0 to 24), more preferably as disclosed in the paragraphs [0059.0.1.1], [0059.0.4.4], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, arginine, glutamate, glutamine and/or proline, preferably L-arginine, L-glutamate, L-glutamine and/or L-proline, its salts, ester or amids in free form or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. stopp In one embodiment in the process of the invention the activity of the *Escherichia coli* K12 protein b3568 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.14.14], is increased, preferably in an organelle, most preferably in a plastid, conferring an increase of a fine chemical, whereby the fine chemical is at least one compound selected from the group consisting of fatty acids such as hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7,10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, or cerotic acid, lignoceric acid, behenic acid or melissic acid in free form or bound to other compounds such as triglycerides, glycolipids, phospholipids, waxes etc., or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b3616 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.23.23], [0037.0.23.23], [0059.0.23.23], [0060.0.23.23], e.g. the activity as defined in the respective aforementioned paragraphs [0059.0.m.n] (where m and n can be one or more numbers between 0 to 24), more preferably as disclosed in the paragraphs [0059.0.13.13], [0059.0.23.23], is increased, conferring an increase of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, organic acids such as salicylic acid in free form or bound to other compounds such as its salts, ester, thioester or in free form or bound to other compounds, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b3616 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.1.1], [0037.0.1.1], [0059.0.1.1], [0060.0.1.1], [0036.0.16.16], [0037.0.16.16], [0059.0.16.16], [0060.0.16.16], [0036.0.18.18], [0037.0.18.18], [0059.0.18.18], [0060.0.18.18], e.g. the activity as defined in the respective aforementioned paragraphs [0059.0.m.n] (where m and n can be one or more numbers between 0 to 24), more preferably as disclosed in the paragraphs [0059.0.0.0], [0059.0.1.1], [0059.0.16.16], [0059.0.18.18], is increased, preferably in an organelle, most preferably in a plastid, conferring a decrease of a fine chemical, whereby the fine chemical is at least one compound selected from the group consisting of amino acids such as methionine, preferably L-methionine in free form or its salts or bound to proteins, threonine, preferably L-threonine in free form or its salts or bound to proteins, organic acids such as gamma-aminobutyric acid and/or putrescine and/or shikimate, ferulic acid sinapic acid, in free form or bound to other compounds such as its salts, ester, thioester or in free form or bound to other compounds such sugars or sugar polymers, like glucoside, e.g. diglucoside, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b3708 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.12.12], [0037.0.12.12], [0059.0.12.12], [0060.0.12.12], [0036.0.14.14], [0037.0.14.14], [0059.0.14.14], [0060.0.14.14], [0036.0.19.19], [0037.0.19.19], [0059.0.19.19], [0060.0.19.19], [0036.0.21.21], [0037.0.21.21], [0059.0.21.21], [0060.0.21.21], [0036.0.22.22], [0037.0.22.22], [0059.0.22.22], [0060.0.22.22], e.g. the activity as defined in the respective aforementioned paragraphs [0059.0.m.n] (where m and n can be one or more numbers between 0 to 24), more preferably as disclosed in the paragraphs [0059.0.5.5], [0059.0.12.12], [0059.0.14.14], [0059.0.19.19], [0059.0.21.21], [0059.0.22.22], is increased, preferably in an organelle, most preferably in a plastid, conferring an increase of a fine chemical, whereby the fine chemical is at least one compound selected from the group consisting of fatty acids such as linoleic acid and/or triglycerides, lipids, oils and/or fats containing linoleic acid, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7,10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7,10,13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acidin free form or bound to other compounds such as triglycerides, glycolipids, phospholipids etc., phytostyrols such as beta-sitosterol, sitostanol, stigmasterol, brassicasterol, campestanol, isofucosterol and campesterol, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, glycolipids such as glycolipids containing galactose, glucose, mannose, rhamnose or xylose, more preferably a galactolipid containing galactose or glucose, most preferably a galactolipid containing galactose or mixtures thereof in free form or bound to other compounds, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b3728 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.5.5], [0059.0.14.14], is increased, preferably in an organelle, most preferably in a plastid, conferring an increase of a fine chemical, whereby the fine chemical is at least one compound selected from the group consisting of fatty acids such as linoleic acid and/or triglycerides, lipids, oils and/or fats containing linoleic acid, hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7,10,13 hexadecatrienoic acid or hexadecenoic acid, preferably 9-hexadecenoic acid, more preferably trans-9-hexadecenoic acid and/or 2-hydroxy palmitic acid and/or heptadecanoic acid hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acidin free form or bound to other compounds such as triglycerides, glycolipids, phospholipids etc., or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Escherichia coli* K12 protein b3770 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.17.17], [0037.0.17.17], [0059.0.17.17], [0060.0.17.17], e.g. the activity as defined in the respective aforementioned paragraphs [0059.0.m.n] (where m and n can be one or more numbers between 0 to 24), more preferably as disclosed in the paragraphs [0059.0.3.3], [0059.0.17.17], is increased, preferably in an organelle, most preferably in a plastid, conferring an increase of a fine chemical, whereby the fine chemical is at least one compound selected from the group consisting of amino acids such as leucine, isoleucine and/or valine, preferably L-leucine, L-isoleucine and/or L-valine, its salts, ester or amids in free form or bound to proteins, organic acids such as citramalic acid, glyceric acid, fumaric acid, malic acid, pyruvic acid, succinic acid and/or threonolactone or their salts, amides, thioesters or esters in free form or bound to other compounds such as proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b3770 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], e.g. the activity as defined in the respective aforementioned paragraphs [0059.0.m.n] (where m and n can be one or more numbers between 0 to 24), more preferably as disclosed in the paragraphs [0059.0.3.3], is increased, preferably in an organelle, most preferably in a plastid, conferring a decrease of a fine chemical, whereby the fine chemical is at least one compound selected from the group consisting of amino acids such as leucine, isoleucine and/or valine, preferably L-leucine, L-isoleucine and/or L-valine, its salts, ester or amids in free form or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Escherichia coli* K12 protein b4039 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.1.1], [0037.0.1.1], [0059.0.1.1], [0060.0.1.1], [0036.0.4.4], [0037.0.4.4], [0059.0.4.4], [0060.0.4.4], [0036.0.17.17], [0037.0.17.17], [0059.0.17.17], [0060.0.17.17], [0036.0.23.23], [0037.0.23.23], [0059.0.23.23], [0060.0.23.23], e.g. the activity as defined in the respective aforementioned paragraphs [0059.0.m.n] (where m and n can be one or more numbers between 0 to 24), more preferably as disclosed in the paragraphs [0059.0.0.0], [0059.0.1.1], [0059.0.4.4], [0059.0.17.17], [0059.0.23.23], is increased, preferably in an organelle, most preferably in a plastid, conferring an increase of a fine chemical, whereby the fine chemical is at least one compound selected from the group consisting of amino acids such as methionine, preferably L-methionine in free form or its salts or bound to proteins, threonine, preferably L-threonine in free form or its salts or bound to proteins, arginine, glutamate, glutamine and/or proline, preferably L-arginine, L-glutamate, L-glutamine and/or L-proline in free form or its salts or bound to proteins, coenzymes such as Coenzyme Q9 or Coenzyme Q10 or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, organic acids such as salicylic acid in free form or its salts or its ester or bound, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Escherichia coli* K12 protein b4039 or its homologs, preferably in an organelle, most preferably in a plastid, is especially preferred for an increased production of limiting amino acids in various crop plants for the feed industry.

In one embodiment in the process of the invention the activity of the *Escherichia coli* K12 protein b4139 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.17.17], [0037.0.17.17], [0059.0.17.17], [0060.0.17.17], e.g. the activity as defined in the respective aforementioned paragraphs [0059.0.m.n] (where m and n can be one or more numbers between 0 to 24), more preferably as disclosed in the paragraphs [0059.0.3.3], [0059.0.17.17], is increased, preferably in an organelle, most preferably in a plastid, conferring an increase of a fine chemical, whereby the fine chemical is at least one compound selected from the group consisting of amino acids such as arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, organic acids such as citramalic acid, glyceric acid, fumaric acid, malic acid, pyruvic acid, succinic acid and/or threonolactone or their salts, amides, thioesters or esters in free form or bound to other compounds such as proteins, lipids or sugars or sugar polymers, like glucoside, e.g. diglucoside, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Escherichia coli* K12 protein b4139 or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.4.4], [0037.0.4.4], [0059.0.4.4], [0060.0.4.4], [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.1.1], [0059.0.4.4], [0059.0.15.15], is increased, preferably in an organelle, most preferably in a plastid, conferring a decrease of a fine chemical, whereby the fine chemical is at least one compound selected from the group consisting of amino acids such as threonine, preferably L-threonine in free form or its salts or bound to proteins, arginine, glutamate, glutamine and/or proline, preferably L-arginine, L-glutamate, L-glutamine and/or L-proline in free form or its salts or bound to proteins, organic acids such as citramalic acid, glyceric acid, fumaric acid, malic acid, pyruvic acid, succinic acid and/or threonolactone or their salts, amides, thioesters or esters in free form or bound to other compounds such as proteins, lipids or sugars or sugar polymers, like glucoside, e.g. diglucoside, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YAL038W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.4.4], [0037.0.4.4], [0059.0.4.4], [0060.0.4.4], [0036.0.13.13], [0037.0.13.13], [0059.0.13.13], [0060.0.13.13], [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.3.3], [0059.0.4.4], [0059.0.13.13], [0059.0.15.15], is increased, preferably in an organelle, most preferably in a plastid, conferring an increase of a fine chemical, whereby the fine chemical is at least one compound selected from the group consisting of amino acids such as leucine, isoleucine and/or valine, preferably L-leucine, L-isoleucine and/or L-valine, its salts, ester or amids in free form or bound to proteins, arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, organic acids such as citramalic acid, glyceric acid, fumaric acid, malic acid, pyruvic acid, succinic acid and/or threonolactone or their salts, amides, thioesters or esters in free form or bound to other compounds such as proteins, lipids or sugars or sugar polymers, like glucoside, e.g. diglucoside, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YAL038W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.13.13], is increased, preferably in an organelle, most preferably in a plastid, conferring a decrease of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YBL082C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.1.1], [0059.0.13.13], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, 5-oxoproline, alanine, aspartic acid, citrulline, glycine, homoserine, phenylalanine, serine and/or tyrosine, its salts, ester or amids in free form or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YBL082C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.15.15], [0037.0.15.15], [0059.0.15.15], [0060.0.15.15], [0036.0.16.16], [0037.0.16.16], [0059.0.16.16], [0060.0.16.16], e.g. the activity as defined in the respective aforementioned paragraphs [0059.0.m.n] (where m and n can be one or more numbers between 0 to 24), more preferably as disclosed in the paragraphs [0059.0.13.13], [0059.0.15.15], [0059.0.16.16], is increased, preferably in an organelle, most preferably in a plastid, conferring a decrease of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, organic acids such as citramalic acid, glyceric acid, fumaric acid, malic acid, pyruvic acid, succinic acid and/or threonolactone or their salts, amides, thioesters or esters in free form or bound to other compounds such as proteins, gamma-aminobutyric acid and/or putrescine and/or shikimate in free form or bound to other compounds such as its salts, ester, thioester or in free form or bound to other compounds such sugars or sugar polymers, like glucoside, e.g. diglucoside, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YBR001C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], e.g. the activity as defined in the respective aforementioned paragraphs [0059.0.m.n] (where m and n can be one or more numbers between 0 to 24), more preferably as disclosed in the paragraphs [0059.0.4.4], is increased, preferably in an organelle, most preferably in a plastid, conferring an increase of a fine chemical, whereby the fine chemical is at least one compound selected from the group consisting of amino acids such as arginine, glutamate, glutamine and/or proline, preferably L-arginine, L-glutamate, L-glutamine and/or L-proline in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YBR001C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.15.15], is increased, preferably in an organelle, most preferably in a plastid, conferring an decrease of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters in free form or bound to other compounds such as proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YDR035W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], [0036.0.12.12], [0037.0.12.12], [0059.0.12.12], [0060.0.12.12], [0036.0.13.13], [0037.0.13.13], [0059.0.13.13], [0060.0.13.13], [0036.0.14.14], [0037.0.14.14], [0059.0.14.14],

[0060.0.14.14], [0036.0.16.16], [0037.0.16.16], [0059.0.16.16], [0060.0.16.16], [0036.0.18.18], [0037.0.18.18], [0059.0.18.18], [0060.0.18.18], [0036.0.19.19], [0037.0.19.19], [0059.0.19.19], [0060.0.19.19], [0036.0.20.20], [0037.0.20.20], [0059.0.20.20], [0060.0.20.20], [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.2.2], [0059.0.12.12], [0059.0.13.13], [0059.0.14.14], [0059.0.16.16], [0059.0.18.18], [0059.0.19.19], [0059.0.20.20], [0059.0.21.21], is increased, preferably in an organelle, most preferably in a plastid, conferring an increase of a fine chemical, whereby the fine chemical is at least one compound selected from the group consisting of amino acids such as tryptophane, preferably L-tryptophane, 5-oxoproline, alanine, aspartic acid, citrulline, glycine, homoserine, phenylalanine, serine and/or tyrosine in free form or its salts or bound to proteins, phytostyrols such as beta-sitosterol, sitostanol, stigmasterol, brassicasterol, campestanol, isofucosterol and campesterol, fatty acids such as hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acidin free form or bound to other compounds such as triglycerides, glycolipids, phospholipids etc., organic acids such as gamma-aminobutyric acid and/or putrescine and/or shikimate in free form or bound to other compounds such as its salts, ester, thioester or in free form or bound to other compounds such sugars or sugar polymers, like glucoside, e.g. diglucoside, ferulic acid or sinapic acid, its salts, ester, thioester or in free form or bound to other compounds such sugars or sugar polymers, like glucoside, e.g. diglucoside, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, fatty acids such as cerotic acid, lignoceric acid, behenic acid or melissic acid or mixtures thereof in free or bound form, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YDR035W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], [0036.0.13.13], [0037.0.13.13], [0059.0.13.13], [0060.0.13.13], [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.4.4], [0059.0.13.13], [0059.0.15.15], is increased, preferably in an organelle, most preferably in a plastid, conferring andecrease of a fine chemical, whereby the fine chemical is at least one compound selected from the group consisting of amino acids such as arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, organic acids such as citramalic acid, glyceric acid, fumaric acid, malic acid, pyruvic acid, succinic acid and/or threonolactone or their salts, amides, thioesters or esters, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XII or XIII. Most preferably some of the aforementioned fine chemicals are increased whereas other fine chemicals are decreased.

In one embodiment in the process of the invention the activity of the *Saccharomyces cerevisiae* protein YDR430C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.4.4], [0037.0.4.4], [0059.0.4.4], [0060.0.4.4], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.1.1], [0059.0.4.4], [0059.0.13.13], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine, in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Saccharomyces cerevisiae* protein YDR430C or its homologs, preferably in an organelle, most preferably in a plastid, is especially preferred for an increased production of limiting amino acids in various crop plants for the feed industry.

In one embodiment in the process of the invention the activity of the *Saccharomyces cerevisiae* protein YDR497C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.3.3], [0059.0.13.13], [0059.0.19.19], is increased, preferably in an organelle, most preferably in a plastid, conferring an increase of a fine chemical, whereby the fine chemical is at least one compound selected from the group consisting of amino acids such as leucine, isoleucine and/or valine, preferably L-leucine, L-isoleucine and/or L-valine in free form or its salts or bound to proteins, 5-oxoproline, alanine, aspartic acid, citrulline, glycine, homoserine, phenylalanine, serine and/or tyrosine in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myoinositol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YDR497C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.16.16], [0037.0.16.16], [0059.0.16.16], [0060.0.16.16], e.g. the activity as defined in the respective aforementioned paragraphs [0059.0.m.n] (where m and n can be one or more numbers between 0 to 24), more preferably as disclosed in the paragraphs [0059.0.16.16], is increased, preferably in an organelle, most preferably in a plastid, conferring a decrease of a fine chemical, whereby the fine chemical is at least one compound selected from the group consisting of organic acids such as gamma-aminobutyric acid and/or putrescine and/or shikimate in free form or bound to other compounds such as its salts, ester, thioester or in free form or bound to other compounds such sugars or sugar polymers, like glucoside, e.g. diglucoside, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in XIII. Most preferably some of the aforementioned fine chemicals are increased whereas other fine chemicals are decreased.

In one embodiment in the process of the invention the activity of the *Saccharomyces cerevisiae* protein YEL046C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.3.3], [0037.0.3.3], [0059.0.3.3], [0060.0.3.3], [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.0.0], [0059.0.3.3], [0059.0.13.13], [0059.0.19.19], is increased, preferably in an organelle, most preferably in a plastid, conferring an increase of a fine chemical, whereby the fine chemical is at least one compound selected from the group consisting of amino acids such as methionine, preferably L-methionine in free form or its salts or bound to proteins, leucine, isoleucine and/or valine, preferably L-leucine, L-isoleucine and/or L-valine in free form or its salts or bound to proteins, 5-oxoproline, alanine, aspartic acid, citrulline, glycine, homoserine, phenylalanine, serine and/or tyrosine in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YEL046C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.1.1], [0059.0.19.19], is increased, preferably in an organelle, most preferably in a plastid, conferring a decrease of a fine chemical, whereby the fine chemical is at least one compound selected from the group consisting of amino acids such as threonine, preferably L-threonine in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YER024W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], [0036.0.3.3], [0037.0.3.3], [0059.0.3.3], [0060.0.3.3], [0036.0.4.4], [0037.0.4.4], [0059.0.4.4], [0060.0.4.4], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.2.2], [0059.0.3.3], [0059.0.4.4], [0059.0.19.19], is increased, preferably in an organelle, most preferably in a plastid, conferring an increase of a fine chemical, whereby the fine chemical is at least one compound selected from the group consisting of amino acids such as tryptophane, preferably L-tryptophane in free form or its salts or bound to proteins, arginine, preferably L-arginine in free form or its salts or bound to proteins leucine, isoleucine and/or valine, preferably L-leucine, L-isoleucine and/or L-valine in free form or its salts or bound to proteins, leucine, isoleucine and/or valine, preferably L-leucine, L-isoleucine and/or L-valine in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YGL065C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.15.15], [0059.0.19.19], is increased, preferably in an organelle, most preferably in a plastid, conferring an increase of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cervisiae* protein YGL126W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.15.15], is increased, preferably in an organelle, most preferably in a plastid, conferring an increase of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YGL126W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13],

[0060.0.13.13], e.g. the activity as defined in the respective aforementioned paragraphs [0059.0.m.n] (where m and n can be one or more numbers between 0 to 24), more preferably as disclosed in the paragraphs [0059.0.13.13], is increased, preferably in an organelle, most preferably in a plastid, conferring a decrease of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YGR255C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.0.0], [0059.0.19.19], is increased, preferably in an organelle, most preferably in a plastid, conferring an increase of a fine chemical, whereby the fine chemical is at least one compound selected from the group consisting of amino acids such as methionine, L-methionine in free form or its salts or bound to proteins and carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YGR262C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.4.4], [0059.0.19.19], is increased, preferably in an organelle, most preferably in a plastid, conferring an increase of a fine chemical, whereby the fine chemical is at least one compound selected from the group consisting of amino acids such as arginine, glutamate, glutamine and/or proline, preferably L-arginine, L-glutamate, L-glutamine and/or L-proline in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YGR289C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.4.4], [0037.0.4.4], [0059.0.4.4], [0060.0.4.4], e.g. the activity as defined in the respective aforementioned paragraphs [0059.0.m.n] (where m and n can be one or more numbers between 0 to 24), more preferably as disclosed in the paragraphs [0059.0.0.0], [0059.0.4.4], is increased, preferably in an organelle, most preferably in a plastid, conferring an increase of a fine chemical, whereby the fine chemical is at least one compound selected from the group consisting of amino acids such as methionine, preferably L-methionine in free form or its salts or bound to proteins, arginine, glutamate, glutamine and/or proline, preferably L-arginine, L-glutamate, L-glutamine and/or L-proline in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YGR289C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.15.15], [0059.0.19.19], is increased, preferably in an organelle, most preferably in a plastid, conferring a decrease of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters in free form or bound to other compounds such as proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YHR204W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.19.19], is increased, preferably in an organelle, most preferably in a plastid, conferring an increase of a fine chemical, whereby the fine chemical is at least one compound selected from the group consisting of carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YHR204W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.3.3], [0037.0.3.3], [0059.0.3.3], [0060.0.3.3], [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.3.3], [0059.0.13.13], is increased, preferably in an organelle, most preferably in a plastid, conferring a decrease of a fine chemical, whereby the fine chemical is at least one compound selected from the group consisting of amino acids such as leucine, isoleucine and/or valine, preferably L-leucine, L-isoleucine and/or L-valine, 5-oxoproline, alanine, aspartic acid, citrulline, glycine, homoserine, phenylalanine, serine and/or tyrosine in free form or its salts or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YIR020W-B or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.19.19], is increased, preferably in an organelle, most preferably in a plastid, conferring an increase of a fine chemical, whereby the fine chemical is at least one compound selected from the group consisting of carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YJL139C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.15.15], [0059.0.19.19], is increased, preferably in an organelle, most preferably in a plastid, conferring an increase of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YJR073C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.14.14], is increased, preferably in an organelle, most preferably in a plastid, conferring an increase of a fine chemical, whereby the fine chemical is at least one compound selected from the group consisting of fatty acids hexadecenoic acid, preferably hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid in free form or bound to other compounds such as triglycerides, glycolipids, phospholipids etc., or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YJR073C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.15.15], is increased, preferably in an organelle, most preferably in a plastid, conferring adecrease of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Tabler XIII. Most preferably some of the aforementioned fine chemicals are increased whereas other fine chemicals are decreased.

In one embodiment in the process of the invention the activity of the *Saccharomyces cerevisiae* protein YKR043C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.1.1], [0037.0.1.1], [0059.0.1.1], [0060.0.1.1], [0036.0.3.3], [0037.0.3.3], [0059.0.3.3], [0060.0.3.3], [0036.0.4.4], [0037.0.4.4], [0059.0.4.4], [0060.0.4.4], [0036.0.13.13], [0037.0.13.13], [0059.0.13.13], [0060.0.13.13], [0036.0.15.15], [0037.0.15.15], [0059.0.15.15], [0060.0.15.15], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.0.0], [0059.0.1.1], [0059.0.3.3], [0059.0.4.4], [0059.0.13.13], [0059.0.15.15], [0059.0.19.19], is increased, preferably in an organelle, most preferably in a plastid, conferring an increase of a fine chemical, whereby the fine chemical is at least one compound selected from the group consisting of amino acids such as methionine, preferably L-methionine in free form or its salts or bound to proteins, threonine, preferably L-threonine in free form or its salts or bound to proteins, leucine, isoleucine and/or valine, preferably L-leucine, L-isoleucine and/or L-valine in free form or its salts or bound to proteins, arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine, in free form or its salts or bound to proteins, organic acids such as citramalic acid, glyceric acid, fumaric acid, malic acid, pyruvic acid, succinic acid and/or threonolactone or their salts, amides, thioesters or esters, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YKR043C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.15.15], is increased, preferably in an organelle, most preferably in a plastid, conferring a decrease of a fine chemical, whereby the fine chemical is at least one compound selected from the group consisting of organic acids such as citramalic acid, glyceric acid, fumaric acid, malic acid, pyruvic acid, succinic acid and/or threonolactone or their salts, amides, thioesters or esters, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased. The expression of *Saccharomyces cerevisiae* protein YKR043c or its homologs, preferably in an organelle, most preferably in a plastid, is especially preferred for an increased production of limiting amino acids in various crop plants for the feed industry.

In one embodiment in the process of the invention the activity of the *Saccharomyces cerevisiae* protein YLL033W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.19.19], [0037.0.19.19], [0059.0.19.19], [0060.0.19.19], [0036.0.23.23], [0037.0.23.23], [0059.0.23.23], [0060.0.23.23], e.g. the activity as defined in the respective aforementioned paragraphs [0059.0.m.n] (where m and n can be one or more numbers between 0 to 24), more preferably as disclosed in the paragraphs [0059.0.19.19], [0059.0.23.23], is increased, preferably in an organelle, most preferably in a plastid, conferring an increase of a fine chemical, whereby the fine chemical is at least one compound selected from the group consisting of carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, organic acids such as salicylic acid in free form or its salts or its ester or bound, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YLL033W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.21.21], [0037.0.21.21], [0059.0.21.21], [0060.0.21.21], e.g. the activity as defined in the respective aforementioned paragraphs [0059.0.m.n] (where m and n can be one or more numbers between 0 to 24), more preferably as disclosed in the paragraphs [0059.0.21.21], is increased, preferably in an organelle, most preferably in a plastid, conferring a decrease of a fine chemical, whereby the fine chemical is at least one compound selected from the group consisting of glycerol and/or glycerol-3-phosphate, its salts, ester, thioester or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids or carbohydrates such as sugars or sugar polymers, like glucosides or polyols like myo-inositol, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YLR027C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], [0036.0.12.12], [0037.0.12.12], [0059.0.12.12], [0060.0.12.12], e.g. the activity as defined in the respective aforementioned paragraphs [0059.0.m.n] (where m and n can be one or more numbers between 0 to 24), more preferably as disclosed in the paragraphs [0059.0.4.4], [0059.0.12.12], is increased, preferably in an organelle, most preferably in a plastid, conferring an increase of a fine chemical, whereby the fine chemical is at least one compound selected from the group consisting of amino acids such as arginine, glutamate, glutamine and/or proline, preferably L-arginine, L-glutamate, L-glutamine and/or L-proline in free form or its salts or bound to proteins, phytostyrols such as beta-sitosterol, sitostanol, stigmasterol, brassicasterol, campestanol, isofucosterol and campesterol, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharmoyces cerevisiae* protein YLR027C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.14.14], [0037.0.14.14], [0059.0.14.14], [0060.0.14.14], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.13.13], [0059.0.14.14], [0059.0.19.19], is increased, preferably in an organelle, most preferably in a plastid, conferring a decrease of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, fatty acids such as hexadecenoic acid, preferably hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid in free form or bound to other compounds such as triglycerides, glycolipids, phospholipids etc., carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased. The expression of *Saccharomyces cerevisiae* protein YLR027c or its homologs, preferably in an organelle, most preferably in a plastid, is especially preferred for an increased production of phytosterols in various crop plants for the for the production of functional feed or food.

In one embodiment in the process of the invention the activity of the *Saccharomyces cerevisiae* protein YLR099C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.7.7], [0037.0.7.7], [0059.0.7.7], [0060.0.7.7], [0036.0.8.8], [0037.0.8.8], [0059.0.8.8], [0060.0.8.8], [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.7.7], [0059.0.8.8], [0059.0.24.24], is increased, preferably in an organelle, most preferably in a plastid, conferring an increase of a fine chemical, whereby the fine chemical is at least one compound selected from the group consisting of fatty acids such as stearic acid or triglycerides, lipids, oils or fats containing stearic acid, stearic acid and its salts, ester, thioester or stearic acid in free form or bound to other compounds such as triglycerides, glycolipids, phospholipids etc., palmitic acid or triglycerides, lipids, oils or fats containing palmitic acid, palmitic acid and its salts, ester, thioester or palmitic acid in free form or bound to other compounds such as triglycerides, glycolipids, phospholipids etc., carotenoids such as beta-carotene or its/their precursor(s), e.g. isopentyl pyrophosphate (IPP), or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YLR099C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.14.14], [0037.0.14.14], [0059.0.14.14], [0060.0.14.14], e.g. the activity as defined in the respective aforementioned paragraphs [0059.0.m.n] (where m and n can be one or more numbers between 0 to 24), more preferably as disclosed in the paragraphs [0059.0.14.14], is increased, preferably in an organelle, most preferably in a plastid, conferring a decrease of a fine chemical, whereby the fine chemical is at least one compound selected from the group consisting of fatty acids such as hexadecenoic acid, preferably hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9- octadecenoic acid and/or hexadecatrienoic acid, preferably delta 7, 10, 13 hexadecatrienoic acid in free form or bound to other compounds such as triglycerides, glycolipids, phospholipids etc., or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased. The expression of the *Saccharomyces cerevisiae* protein YLR099c or its homologs ie especially preferred for an increased production of fatty acid, polyunsaturated fatty acid or oil production in various plants.

In one embodiment in the process of the invention the activity of the *Saccharomyces cerevisiae* protein YLR153C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.0.0], [0037.0.0.0], [0059.0.0.0], [0060.0.0.0], [0036.0.1.1], [0037.0.1.1], [0059.0.1.1], [0060.0.1.1], [0036.0.19.19], [0037.0.19.19], [0059.0.19.19], [0060.0.19.19], [0036.0.20.20], [0037.0.20.20], [0059.0.20.20], [0060.0.20.20], e.g. the activity as defined in the respective aforementioned paragraphs [0059.0.m.n] (where m and n can be one or more numbers between 0 to 24), more preferably as disclosed in the paragraphs [0059.0.0.0], [0059.0.1.1], [0059.0.19.19], [0059.0.20.20], is increased, preferably in an organelle, most preferably in a plastid, conferring an increase of a fine chemical, whereby the fine chemical is at least one compound selected from the group consisting of amino acids such as methionine, preferably L-methionine in free form or its salts or bound to proteins, threonine, preferably L-threonine in free form or its salts or bound to proteins, carbohydrates such as myoinositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, fatty acids such as cerotic acid lignoceric acid or melissic acid or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Saccharomyces cerevisiae* protein YLR153c or its homologs, preferably in an organelle, most preferably in a plastid, is especially preferred for an increased production of limiting amino acids in various crop plants for the feed industry.

In one embodiment in the process of the invention the activity of the *Saccharomyces cerevisiae* protein YLR174W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.3.3], [0037.0.3.3], [0059.0.3.3], [0060.0.3.3], [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.1.1], [0059.0.3.3], [0059.0.13.13], [0059.0.19.19], [0059.0.20.20], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, leucine, isoleucine and/or valine, preferably L-leucine, L-isoleucine and/or L-valine, 5-oxo-proline, alanine, aspartic acid, citrulline, glycine, homoserine, phenylalanine, serine and/or tyrosine in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. The expression of *Saccharomyces cerevisiae* protein YLR174w or its homologs, preferably in an organelle, most preferably in a plastid, is especially preferred for an increased production of limiting amino acids in various crop plants for the feed industry.

In one embodiment in the process of the invention the activity of the *Saccharomyces cerevisiae* protein YMR262W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.4.4], [0037.0.4.4], [0059.0.4.4], [0060.0.4.4], e.g. the activity as defined in the respective aforementioned paragraphs [0059.0.m.n] (where m and n can be one or more numbers between 0 to 24), more preferably as disclosed in the paragraphs [0059.0.1.1], [0059.0.4.4], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, arginine, glutamate, glutamine and/or proline, preferably L-arginine, L-glutamate, L-glutamine and/or L-proline in free form or its salts or bound to proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YNL022C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.19.19], [0037.0.19.19],

[0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.19.19], is increased, preferably in an organelle, most preferably in a plastid, conferring an increase of a fine chemical, whereby the fine chemical is at least one compound selected from the group consisting of carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YNL022C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.4.4], [0037.0.4.4], [0059.0.4.4], [0060.0.4.4], e.g. the activity as defined in the respective aforementioned paragraphs [0059.0.m.n] (where m and n can be one or more numbers between 0 to 24), more preferably as disclosed in the paragraphs [0059.0.4.4], is increased, preferably in an organelle, most preferably in a plastid, conferring a decrease of a fine chemical, whereby the fine chemical is at least one compound selected from the group consisting of amino acids such as arginine, glutamate, glutamine and/or proline, preferably L-arginine, L-glutamate, L-glutamine and/or L-proline in free form or its salts or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XII or XIII. Most preferably some of the aforementioned fine chemicals are increased whereas other fine chemicals are decreased.

In one embodiment in the process of the invention the activity of the *Saccharomyces cerevisiae* protein YNL241C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.2.2], [0037.0.2.2], [0059.0.2.2], [0060.0.2.2], [0036.0.3.3], [0037.0.3.3], [0059.0.3.3], [0060.0.3.3], [0036.0.4.4], [0037.0.4.4], [0059.0.4.4], [0060.0.4.4], [0036.0.6.6], [0037.0.6.6], [0059.0.6.6], [0060.0.6.6], [0036.0.12.12], [0037.0.12.12], [0059.0.12.12], [0060.0.12.12], [0036.0.13.13], [0037.0.13.13], [0059.0.13.13], [0060.0.13.13], [0036.0.14.14], [0037.0.14.14], [0059.0.14.14], [0060.0.14.14], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.1.1], [0059.0.2.2], [0059.0.3.3], [0059.0.4.4], [0059.0.6.6], [0059.0.12.12], [0059.0.13.13], [0059.0.14.14], [0059.0.19.19], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, tryptophane, preferably L-tryptophane in free form or its salts or bound to proteins, leucine, isoleucine and/or valine, preferably L-leucine, L-isoleucine and/or L-valine in free form or its salts or bound to proteins, arginine, glutamate, glutamine and/or proline, preferably L-arginine, L-glutamate, L-glutamine and/or L-proline, 5-oxoproline, alanine, aspartic acid, citrulline, glycine, homoserine, phenylalanine, serine and/or tyrosine in free form or its salts or bound to proteins, fatty acids such as δ-linolenic acid or triglycerides, lipids, oils or fats containing α-linolenic acid, δ-linolenic acid and its salts, ester, thioester or α-linolenic acid in free form or bound to other compounds such as triglycerides, glycolipids, phospholipids etc., hexadecenoic acid, preferably hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or triglycerides, lipids, oils or fats containing hexadecenoic acid, preferably 9-hexadecenoic acid, more preferably trans-9-hexadecenoic acid and/or 2-hydroxy palmitic acid and/or heptadecanoic acid and/or 2-hydroxytetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid, and the salts, ester, thioester of hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid or hexadecenoic acid, preferably 9-hexadecenoic acid, more preferably trans-9-hexadecenoic acid and/or 2-hydroxy palmitic acid and/or heptadecanoic acid and/or 2-hydroxy-tetracosenoic-acid, preferably 2-hydroxy-15-tetracosenoic acid and/or hexadecadienoic acid, preferably delta 7, 10 hexadecadienoic acid (C16:2 (n-6), cis 7-cis 10-hexadecadienoic acid) and/or octadecenoic acid, preferably 9-Octadecenoic acid, more preferably (Z)-9-octadecenoic acid and/or hexadecatrienoic acid, preferably delta 7, 10, 13 hexadecatrienoic acid in free form or bound to other compounds such as triglycerides, glycolipids, phospholipids etc., phytosytols such as beta-sitosterol, sitostanol, stigmasterol, brassicasterol, campestanol, isofucosterol and campesterol, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YNL241 C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.9.9], [0037.0.9.9], [0059.0.9.9], [0060.0.9.9], [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.9.9], [0059.0.15.15], is increased, preferably in an organelle, most preferably in a plastid, conferring a decrease of a fine chemical, whereby the fine chemical is at least one compound selected from the group consisting of vitamins such as vitamin E selected from the group alpha-tocopherol, beta-tocopherol, gamma-tocopherol, delta-tocopherol, alpha-tocotrienol, beta-tocotrienol, gamma-tocotrienol and delta-tocotrienol or its precursor 2,3-Dimethyl-5-phytylquinol, organic acids such as citramalic acid, glyceric acid, fumaric acid, malic acid, pyruvic acid, succinic acid and/or threonolactone or their salts, amides, thioesters or esters in free form or bound to other compounds such as proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XII or XIII. Most preferably some of the aforementioned fine chemicals are increased whereas other fine chemicals are decreased. The expression of *Saccharomyces cerevisiae* protein YNL241c or its homologs, preferably in an organelle, most preferably in a plastid, is especially preferred for an increased production of limiting amino acids in various crop plants for the feed industry.

In one embodiment in the process of the invention the activity of the *Saccharomyces cerevisiae* protein YNR012W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.5.5], [0037.0.5.5], [0059.0.5.5], [0060.0.5.5], [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.5.5], [0059.0.13.13], [0059.0.19.19], is increased, preferably in an organelle, most preferably in a plastid, conferring an increase of a fine chemical, whereby the fine chemical is at least one compound selected from the group consisting of fatty acids such as linoleic acid and/or triglycerides, lipids, oils and/or fats containing linoleic acid, linoleic acid and its salts, ester, thioester or linoleic acid in free form or bound to other compounds such as triglycerides, glycolipids, phospholipids etc., amino acids such as 5-oxoproline, alanine, aspartic acid, citrulline, glycine, homoserine, phenylalanine, serine and/or tyrosine in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YNR012W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.9.9], [0037.0.9.9], [0059.0.9.9], [0060.0.9.9], [0036.0.13.13], [0037.0.13.13], [0059.0.13.13], [0060.0.13.13], [0036.0.20.20], [0037.0.20.20], [0059.0.20.20], [0060.0.20.20], e.g. the activity as defined in the respective aforementioned paragraphs [0059.0.m.n] (where m and n can be one or more numbers between 0 to 24), more preferably as disclosed in the paragraphs [0059.0.9.9], [0059.0.13.13], [0059.0.20.20], is increased, preferably in an organelle, most preferably in a plastid, conferring a decrease of a fine chemical, whereby the fine chemical is at least one compound selected from the group consisting of vitamins such as vitamin E selected from the group alpha-tocopherol, beta-tocopherol, gamma-tocopherol, delta-tocopherol, alpha-tocotrienol, beta-tocotrienol, gamma-tocotrienol and delta-tocotrienol or its precursor 2,3-Dimethyl-5-phytylquinol, amino acids such as 5-oxoproline, alanine, aspartic acid, citrulline, glycine, homoserine, phenylalanine, serine and/or tyrosine in free form or its salts or bound to proteins, fatty acids such as cerotic acid lignoceric acid or melissic acid or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Most preferably some of the aforementioned fine chemicals are increased whereas other fine chemicals are decreased.

In one embodiment in the process of the invention the activity of the *Saccharomyces cerevisiae* protein YOL126C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.15.15], [0037.0.15.15], [0059.0.15.15], [0060.0.15.15], e.g. the activity as defined in the respective aforementioned paragraphs [0059.0.m.n] (where m and n can be one or more numbers between 0 to 24), more preferably as disclosed in the paragraphs [0059.0.15.15], is increased, preferably in an organelle, most preferably in a plastid, conferring an increase of a fine chemical, whereby the fine chemical is at least one compound selected from the group consisting of organis acids such as citramalic acid, glyceric acid, fumaric acid, malic acid, pyruvic acid, succinic acid and/or threonolactone or their salts, amides, thioesters or esters in free form or bound to other compounds such as proteins, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YOR350C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.1.1], [0037.0.1.1], [0059.0.1.1], [0060.0.1.1], [0036.0.15.15], [0037.0.15.15], [0059.0.15.15], [0060.0.15.15], [0036.0.16.16], [0037.0.16.16], [0059.0.16.16], [0060.0.16.16], e.g. the activity as defined in the respective aforementioned paragraphs [0059.0.m.n] (where m and n can be one or more numbers between 0 to 24), more preferably as disclosed in the paragraphs [0059.0.1.1], [0059.0.15.15], [0059.0.16.16], is increased, preferably in an organelle, most preferably in a plastid, conferring an increase of a fine chemical, whereby the fine chemical is at least one compound selected from the group consisting of amino acids such as threonine, preferably L-threonine in free form or its salts or bound to proteins, organis acids such as citramalic acid, glyceric acid, fumaric acid, malic acid, pyruvic acid, succinic acid and/or threonolactone or their salts, amides, thioesters or esters in free form or bound to other compounds such as proteins, gamma-aminobutyric acid and/or putrescine and/or shikimate in free form or bound to other compounds such as its salts, ester, thioester or in free form or bound to other compounds such sugars or sugar polymers, like glucoside, e.g. diglucoside, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YOR353C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.2.2], [0037.0.2.2], [0059.0.2.2], [0060.0.2.2], [0036.0.3.3], [0037.0.3.3], [0059.0.3.3], [0060.0.3.3], [0036.0.13.13], [0037.0.13.13], [0059.0.13.13], [0060.0.13.13], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.2.2], [0059.0.3.3], [0059.0.13.13], [0059.0.19.19], is increased, preferably in an organelle, most preferably in a plastid, conferring an increase of a fine chemical, whereby the fine chemical is at least one compound selected from the group consisting of amino acids such as tryptophane, preferably L-tryptophane in free form or its salts or bound to proteins, leucine, isoleucine and/or valine, preferably L-leucine, L-isoleucine and/or L-valine, 5-oxoproline, alanine, aspartic acid, citrulline, glycine, homoserine, phenylalanine, serine and/or tyrosine in free form or its salts or bound to proteins, carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII.

In one embodiment in the process of the invention the activity of the *Saccharomyces cerevisiae* protein YPL080C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.24.24], [0037.0.24.24], [0059.0.24.24], [0060.0.24.24], e.g. the activity as defined in the respective aforementioned paragraphs [0059.0.m.n] (where m and n can be one or more numbers between 0 to 24), more preferably as disclosed in the paragraphs [0059.0.24.24], is increased, preferably in an organelle, most preferably in a plastid, conferring an increase of a fine chemical, whereby the fine chemical is at least one compound selected from the group consisting of carotenoids such as beta-carotene or its/their precursor, preferably isopentyl pyrophosphate (IPP), geranylgeranylpyrophosphate (GGPP), phytoene, lycopene, zeta-carotene, beta-carotene, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharmoyces cerevisiae* protein YPL080C or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], e.g. the activity as defined in the respective aforementioned paragraphs [0059.0.m.n] (where m and n can be one or more numbers between 0 to 24), more preferably as disclosed in the paragraphs [0059.0.13.13], is increased, preferably in an organelle, most preferably in a plastid, conferring a decrease of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XII or XIII. Most preferably some of the aforementioned fine chemicals are increased whereas other fine chemicals are decreased.

In one embodiment in the process of the invention the activity of the *Saccharomyces cerevisiae* protein YPR035W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.8.8], [0037.0.8.8], [0059.0.8.8], [0060.0.8.8], [0036.0.19.19], [0037.0.19.19], [0059.0.19.19], [0060.0.19.19], e.g. the activity as defined in the respective aforementioned paragraphs [0059.0.m.n] (where m and n can be one or more numbers between 0 to 24), more preferably as disclosed in the paragraphs [0059.0.8.8], [0059.0.19.19], is increased, preferably in an organelle, most preferably in a plastid, conferring an increase of a fine chemical, whereby the fine chemical is at least one compound selected from the group consisting of palmitic acid or triglycerides, lipids, oils or fats containing palmitic acid, palmitic acid and its salts, ester, thioester or palmitic acid in free form or bound to other compounds such as triglycerides, glycolipids, phospholipids etc., carbohydrates such as myo-inositol, fructose, glucose, UDP-glucose, raffinose and/or starch and/or cellulose or mixtures thereof in free form or bound to other compounds such as protein(s) such as enzyme(s), peptide(s), polypeptide(s), membranes or part thereof, or lipids, proteins or carbohydrates or mixtures thereof or in compositions with lipids, or mixtures thereof containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XIII. Preferably in another embodiment in the process of the invention the activity of the *Saccharomyces cerevisiae* protein YPR035W or its homologs, preferably as indicated in the respective aforementioned paragraphs [0036.0.m.n], [0037.0.m.n], [0059.0.m.n], [0060.0.m.n], (where m and n can be one or more numbers between 0 to 24), more preferably as disclosed in the paragraphs [0036.0.13.13], [0037.0.13.13], [0059.0.13.13], [0060.0.13.13], [0036.0.15.15], [0037.0.15.15], [0059.0.15.15], [0060.0.15.15], [0036.0.20.20], [0037.0.20.20], [0059.0.20.20], [0060.0.20.20], e.g. the activity as defined in the respective aforementioned paragraphs [0059.0.m.n] (where m and n can be one or more numbers between 0 to 24), more preferably as disclosed in the paragraphs [0059.0.13.13], [0059.0.15.15], [0059.0.20.20], is increased, preferably in an organelle, most preferably in a plastid, conferring a decrease of a fine chemical, whereby the fine chemical is at least one compound selected from the group consisting of amino acids such as 5-oxoproline, alanine, aspartic acid, citrulline, glycine, homoserine, phenylalanine, serine and/or tyrosine in free form or its salts or bound to proteins, organic acids such as citramalic acid, glyceric acid, fumaric acid, malic acid, pyruvic acid, succinic acid and/or threonolactone or their salts, amides, thioesters or esters, palmitic acid or triglycerides, lipids, oils or fats containing palmitic acid, palmitic acid and its salts, ester, thioester or palmitic acid in free form or bound to other compounds such as triglycerides, glycolipids, phospholipids etc., fatty acids such as cerotic acid lignoceric acid or melissic acid or mixtures thereof in free form or bound to other compounds such as protein(s) such as enzyme(s), peptide(s), polypeptide(s), membranes or part thereof, or lipids, oils, waxes or fatty acids or mixtures thereof or in compositions with lipids, or mixtures thereof, containing at least two, three, four or five compounds selected from the aforementioned groups, preferably 6, 7, 8 or 9 compounds selected from the aforementioned groups, more preferably 10, 11, 12, 13, 14, 15, 16, 17 or more compounds selected from the aforementioned groups, most preferably conferring a metabolite profile as indicated in Table XII or XIII. Most preferably some of the aforementioned fine chemicals are increased whereas other fine chemicals are decreased. The expression of *Saccharomyces cerevisiae* protein YPR035w or its homologs, preferably in an organelle, most preferably in a plastid, is especially preferred for producing plants reduced linolenic acid, which is particularly useful for frying without requiring hydrogenation. Reducing the linolenic acid content produces an oil of better oxidative stability with reduced tendency to produce volatile flavor components.

In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W, is a homolog having said activity and being derived from Eukaryot. In one embodiment, the homolog of the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039 and/or b4139 is a homolog having said activity and being derived from bacteria. In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W is a homolog having said activity and being derived from Fungi. In one embodiment, the homolog of the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039 and/or b4139 and/or b3429 is a homolog having said activity and being derived from Proteobacteria. In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W is a homolog having said activity and being derived from Ascomycota. In one embodiment, the homolog of the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039 and/or b4139 is a homolog having said activity and being derived from Gammaproteobacteria. In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W is a homolog having said activity and being derived from *Saccharomycotina*. In one embodiment, the homolog of the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039 and/or b4139 is a homolog having said activity and being derived from Enterobacteriales. In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W is a homolog having said activity and being derived from *Saccharomycetes*. In one embodiment, the homolog of the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039 and/or b4139 is a homolog having said activity and being derived from Enterobacteriaceae. In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W is a homolog having said activity and being derived from *Saccharomycetales*. In one embodiment, the homolog of the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039 and/or b4139 is a homolog having said activity and being derived from *Escherichia*, preferably from *Escherichia coli*. In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W is a homolog having said activity and being derived from Saccharomycetaceae. In one embodiment, the homolog of the YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W is a homolog having said activity and being derived from *Saccharomycetes*, preferably from *Saccharomyces cerevisiae*.

for the disclosure of this paragraph see paragraph [0038.0.0.0] above.

In accordance with the invention, a protein or polypeptide has the "activity of an protein as shown in table II or IX, column 3" if its de novo activity, or its increased expression directly or indirectly leads to an modified metabolite profile or modified preferably increased in the fine chemical levels in the organism or a part thereof, preferably in a cell of said organism, more preferably in an organelle such as a plastid or mitochondria of said organism and the protein has the above mentioned activities of a protein as shown in table II or IX, column 3, preferably in the event the nucleic acid sequences encoding said proteins is functionally joined to the nucleic acid sequence of a transit peptide. Throughout the specification the activity or preferably the biological activity of such a protein or polypeptide or an nucleic acid molecule or sequence encoding such protein or polypeptide is identical or similar if it still has the biological or enzymatic activity of a protein as shown in table II or IX, column 3, or which has at least 10% of the original enzymatic activity, preferably 20%, particularly preferably 30%, most particularly preferably 40% in comparison to a protein as shown in table II or IX, column 3 of *Saccharomyces cerevisiae* or *Escherichia coli*.

for the disclosure of the paragraphs [0040.0.0.25] to [0047.0.0.25] see paragraphs [0040.0.0.0] to [0047.0.0.0] above.

Preferably, the reference, control or wild type differs form the subject of the present invention only in the cellular activity, preferably of the plastidial activity of the polypeptide of the invention, e.g. as result of an increase in the level of the nucleic acid molecule of the present invention or an increase of the specific activity of the polypeptide of the invention, e.g. by or in the expression level or activity of an protein having the activity of a protein as shown in table II or IX, column 3 its biochemical or genetical causes and the modified preferentially increased amount of the fine chemical.

Preferably, the reference to a process for the control of the production of the fine chemical in the sense of the invention shall mean the increased and/or decrease production of the fine chemical in comparison to a wild type or control organism preferably a microorganism or plant. Said modified or increased production leads preferably to a production, which is at least 5, 6, 7, 8, 9, or 10%, preferably 15, 20, 25, 30, 35, 40, 45 or 50%, more preferably 60, 70, 80, 90 or 100%, most preferably 150, 200, 250, 300, 350, 400, 450 or 500% higher as the wild type or control organism. Said decreased production leads preferably to a production, which is at least 5, 6, 7, 8, 9, or 10%, preferably 15, 20, 25, 30, 35, 40, 45 or 50%, more preferably 60, 70, 80, 90 or 100%, most preferably 150, 200, 250, 300, 350, 400, 450 or 500% lower as the wild type or control organism. Preferably some fine chemicals are increased whereas others are decreased at the same time.

for the disclosure of the paragraphs [0049.0.0.25] to [0051.0.0.25] see paragraphs [0049.0.0.0] to [0051.0.0.0] above.

For example, the molecule number or the specific activity of the polypeptide or the nucleic acid molecule may be increased. Larger or in some case lower amounts of the fine chemical can be produced if the polypeptide or the nucleic acid of the invention is expressed de novo in an organism lacking the activity of said protein, preferably the nucleic acid molecules as mentioned in table I or VIII, columns 5 and 7 alone or preferably in combination with a transit peptide for example as mentioned in table V or in another embodiment by introducing said nucleic acid molecules into an organelle such as an plastid or mitochondria in the transgenic organism. However, it is also possible to modifiy the expression of the gene which is naturally present in the organisms, for example by integrating a nucleic acid sequence, encoding a plastidic targeting sequence in front (5 prime) of the coding sequence, leading to a functional preprotein, which is directed for example to the plastids.

for the disclosure of the paragraphs [0053.0.0.25] to [0058.0.0.25] see paragraphs [0053.0.0.0] to [0058.0.0.0] above.

for the disclosure of the paragraphs [0059.0.25.25] and [0060.025.25] see paragraph [0037.0.25.25] above.

for the disclosure of the paragraphs [0061.0.0.25] and [0062.0.0.25] see paragraphs [0061.0.0.0] and [0062.0.0.0] above.

A protein having an activity conferring a modification, preferentially an increase in the amount or level of the fine chemical, preferably upon targeting to the plastids preferably has the structure of the polypeptide described herein, in particular of the polypeptides comprising the consensus sequence shown in table IV or XI, column 7 or of the polypeptide as shown in the amino acid sequences as disclosed in table II or table IX, columns 5 and 7 or the functional homologues thereof as described herein, or is encoded by the nucleic acid molecule characterized herein or the nucleic acid molecule according to the invention, for example by the nucleic acid molecule as shown in table I or VIII, columns 5 and 7 or its herein described functional homologues and has the herein mentioned activity.

For the purposes of the present invention, the term "the fine chemical" and the compound mentioned under the paragraph 0064.0.m.n] (where m and n can be one or more numbers between 0 to 24), shall have the meaning as disclosed in the paragraphs [0015.0.0.0], [0015.0.1.1], [0015.0.2.2], [0015.0.3.3], [0015.0.4.4], [0015.0.5.5], [0015.0.6.6], [0015.0.7.7], [0015.0.8.8], [0015.0.9.9], [0015.0.10.10], [0015.0.11.11], [0015.0.12.12], [0015.0.13.13], [0015.0.14.14], [0015.0.15.15], [0015.0.16.16], [0015.0.17.17], [0015.0.18.18], [0015.0.19.19], [0015.0.20.20], [0015.0.21.21], [0015.0.22.22], [0015.0.23.23] or [0015.0.24.24] and [0064.0.0.0], [0064.0.1.1], [0064.0.2.2], [0064.0.3.3], [0064.0.4.4], [0064.0.5.5], [0064.0.6.6], [0064.0.7.7], [0064.0.8.8], [0064.0.9.9], [0064.0.10.10], [0064.0.11.11], [0064.0.12.12], [0064.0.13.13], [0064.0.14.14], [0064.0.15.15], [0064.0.16.16], [0064.0.17.17], [0064.0.18.18], [0064.0.19.19], [0064.0.20.20], [0064.0.21.21], [0064.0.22.22], [0064.0.23.23] or [0064.0.24.24].

for the disclosure of the paragraphs [0065.0.0.25] and [0066.0.0.25] see paragraphs [0065.0.0.0] and [0066.0.0.0] above.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having the activity of a protein as indicated in table II or IX, columns 5 and 7 or its homologs activity having herein-mentioned fine chemical increasing activity and/or fine chemical decreasing activity; and/or b) stabilizing a mRNA conferring the increased expression of a protein encoded by the nucleic acid molecule of the invention, which is in the sense of the invention a fusion of a nucleic acid sequence encoding a transit peptide and of a nucleic acid sequence as indicated in table I or VII, columns 5 and 7, e.g. a nucleic acid sequence encoding a polypeptide having the activity of a protein as indicated in table II or IX, columns 5 and 7 or its homologs or of a mRNA encoding the polypeptide of the present invention having herein-mentioned fine chemical increasing activity and/or fine chemical decreasing activity; and/or c) increasing the specific activity of a protein conferring the increased expression of a protein encoded by the nucleic acid molecule of the invention or of the polypeptide of the present invention having herein-mentioned fine chemical increasing activity and/or fine chemical decreasing activity, e.g. of a polypeptide having the activity of a protein as indicated in table II or IX, columns 5 and 7 or its homologs activity, or decreasing the inhibitory regulation of the polypeptide of the invention; and/or d) generating or increasing the expression of an endogenous or artificial transcription factor mediating the expression of a protein conferring the increased expression of a protein encoded by the nucleic acid molecule of the invention or of the polypeptide of the invention having herein-mentioned fine chemical increasing activity and/or fine chemical decreasing activity, e.g. of a polypeptide having the activity of a protein as indicated in table II or IX, columns 5 and 7 or its homologs activity; and/or e) stimulating activity of a protein conferring the increased expression of a protein encoded by the nucleic acid molecule of the present invention or a polypeptide of the present invention having herein-mentioned fine chemical increasing activity and/or fine chemical decreasing activity, e.g. of a polypeptide having the activity of a protein as indicated in table II or IX, columns 5 and 7 or its homologs activity, by adding one or more exogenous inducing factors to the organisms or parts thereof; and/or f) expressing a transgenic gene encoding a protein conferring the increased expression of a polypeptide encoded by the nucleic acid molecule of the present invention or a polypeptide of the present invention, having herein-mentioned fine chemical increasing activity and/or fine chemical decreasing activity, e.g. of a polypeptide having the activity of a protein as indicated in table II or IX, columns 5 and 7 or its homologs, and/or g) increasing the copy number of a gene conferring the increased expression of a nucleic acid molecule encoding a polypeptide encoded by the nucleic acid molecule of the invention or the polypeptide of the invention having herein-mentioned fine chemical increasing activity and/or fine chemical decreasing activity, e.g. of a polypeptide having the activity of a protein as indicated in table II or IX, columns 5 and 7 or its homologs; and/or h) increasing the expression of the endogenous gene encoding the polypeptide of the invention, e.g. a polypeptide having the activity of a protein as indicated in table II or IX, columns 5 and 7 or its homologs activity, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced or decreased fine chemical production; and/or j) selecting of organisms with especially high activity of the proteins of the invention from natural or from mutagenized resources and breeding them into the target organisms, e.g. the elite crops; and/or k) directing a protein encoded by the nucleic acid molecule of the invention or of the polypeptide of the present invention having herein-mentioned fine chemical increasing activity and/or fine chemical decreasing activity, e.g. of a polypeptide having the activity of a protein as indicated in table II or IX, columns 5 and 7 or its homologs activity, to the plastids by the addition of a plastidial targeting sequence; and/or l) generating the expression of a protein encoded by the nucleic acid molecule of the invention or of the polypeptide of the present invention having herein-mentioned fine chemical increasing activity and/or fine chemical decreasing activity, e.g. of a polypeptide having the activity of a protein as indicated in table II or IX, columns 5 and 7 or its homologs activity in plastids by the stable or transient transformation advantageously stable transformation of organelles preferably plastids with an inventive nucleic acid sequence preferably in form of an expression cassette containing said sequence leading to the plastidial expression of the nucleic acids or polypeptides of the invention; and/or m) generating the expression of a protein encoded by the nucleic acid molecule of the invention or of the polypeptide of the present invention having herein-mentioned fine chemical increasing activity and/or fine chemical decreasing activity, e.g. of a polypeptide having the activity of a protein as indicated in table II or IX, columns 5 and 7 or its homologs activity in plastids by integration of a nucleic acid of the invention into the plastidal genome under control of preferable a plastidial promoter.

Preferably, said mRNA is the nucleic acid molecule of the present invention and/or the protein conferring the increased expression of a protein encoded by the nucleic acid molecule of the present invention alone or linked to a transit nucleic acid sequence or transit peptide encoding nucleic acid sequence or the polypeptide having the herein mentioned activity, e.g. conferring the increase and/or decrease of the fine chemical after increasing the expression or activity of the encoded polypeptide preferably in organelles such as plastids or having the activity of a polypeptide having an activity as the protein as shown in table II or IX, column 3 or its homologs. Preferably the increase or decrease of the fine chemical takes place in plastids.

for the disclosure of the paragraphs [0069.0.0.25] to [0079.0.0.25] see paragraphs [0069.0.0.0] to [0079.0.0.0] above.

The activation of an endogenous polypeptide having abovementioned activity, e.g. having the activity of a protein as indicated in table II or IX, column 3 or of the polypeptide of the invention, e.g. conferring the increase and/or decrease of the fine chemical after increase of expression or activity in the cytsol and/or in an organelle like a plastid, preferentially in the plastid, can also be increased by introducing a synthetic transcription factor, which binds close to the coding region of the gene encoding the protein as shown in table II or IX, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II or IX, column 3. The expression of the chimeric transcription factor in a organism, in particular in a plant, leads to a specific expression of the protein as depicted in table II or IX, column 3, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

for the disclosure of the paragraphs [0081.0.0.25] to [0084.0.0.25] see paragraphs [0081.0.0.0] to [0084.0.0.0] above.

Owing to the introduction of a gene or a plurality of genes conferring the expression of the nucleic acid molecule of the invention or the polypeptide of the invention, for example the nucleic acid construct mentioned below, or encoding the protein as shown in table II or IX, column 3 into an organism alone or in combination with other genes, it is possible not only to increase and/or decrease the biosynthetic flux towards the end product, but also to increase, decrease, modify and/or create de novo an advantageous, preferably novel metabolites composition in the organism, e.g. an advantageous fine chemical composition comprising a higher content of (from a viewpoint of nutrional physiology limited) fine chemical such as amino acids, like methionine, lysine or threonine alone or in combination in free or bound form.

for the disclosure of this paragraph see paragraph [0086.0.0.0] above.

By influencing the metabolism thus, it is possible to produce, in the process according to the invention, further advantageous compounds. Examples of such compounds are, in addition to fine chemicals such as amino acids like methionine, threonine, tryptophane for example compounds like other amino acids such as lysine or other desirable compounds.

Accordingly, in one embodiment, the process according to the invention relates to a process, which comprises:

a) providing a non-human organism, preferably a microorganism, a non-human animal, a plant or animal cell, a plant or animal tissue or a plant, more preferably a microorganism, a plant or a plant tissue;

b) increasing the activity of a protein as shown in table II or IX, column 3 or of a polypeptide being encoded by the nucleic acid molecule of the present invention and described below, e.g. conferring an increase and/or decrease of the fine chemical in the organism preferably according to table XII or XIII, preferably in the microorganism, the non-human animal, the plant or animal cell, the plant or animal tissue or the plant, more preferably a microorganism, a plant or a plant tissue, in the cytsol or in the plastids, preferentially in the plastids, c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and d) if desired, recovering, optionally isolating, the free and/or bound the fine chemical and, optionally further free and/or bound fine chemicals synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound fine chemical or the free and bound the fine chemical but as option it is also possible to produce, recover and, if desired isolate, other free or/and bound fine chemicals as, in particular amino acids, organic acids, fatty acids, vitamins, phytostyrols, glycolipids, coenzymes, xanthopylls, carotenoids, carbohydrates etc.

for the disclosure of the paragraphs [0090.0.0.25] to [0097.0.0.25] see paragraphs [0090.0.0.0] to [0097.0.0.0] above.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as shown in table I or VII, columns 5 and 7 or a derivative thereof, or
b) a genetic regulatory element, for example a promoter, which is functionally linked to the nucleic acid sequence as shown table I or VIII, columns 5 and 7 or a derivative thereof, or
c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp. In a preferred embodiment the nucleic acid sequence as shown in table I or VIII, columns 5 and 7 or a derivative thereof are in operational linkage to a nucleic acid sequence encoding a plastidal targeting sequence or a linked to a plastidal promotor in the plastidal genome leading in all these cases to the functional expression of the nucleic acid sequence as shown in table I or VIII, columns 5 and 7 or a derivative thereof, in the plastidal compartment.

The use of the nucleic acid sequence according to the invention or of the nucleic acid construct according to the invention for the generation of transgenic plants is therefore also subject matter of the invention. As mentioned above the inventive nucleic acid sequence consists advantageously of the nucleic acid sequences as depicted in the sequence protocol and disclosed in table I and/or VIII, columns 5 and 7 joined to a nucleic acid sequence encoding a transit peptide, or a targeting nucleic acid sequence which directs the nucleic acid sequences disclosed in table I or VIII, columns 5 and 7 to the organelle preferentially the plastids. Alternatively the inventive nucleic acids sequences consist advantageously of the nucleic acid sequences as depicted in the sequence protocol and disclosed in table I or VIII, columns 5 and 7 joined preferably to a nucleic acids sequence mediating the stable integration of nucleic acids into the plastidial genome and optionally sequences mediating the transcription of the sequence in the plastidial compartment. A transient expression is in principal also desirable and possible.

for the disclosure of this paragraph see paragraph [0100.0.0.0] above.

In an advantageous embodiment of the invention, the organism takes the form of a plant whose fine chemical content is modified advantageously owing to the nucleic acid molecule of the present invention expressed. This is important for plant breeders since, for example in the case of amino acids as fine chemicals, the nutritional value of plants for monogastric animals is limited by a few essential amino acids such as lysine, threonine or methionine. After the activity of the protein as shown in table II or IX, column 3 has been increased or generated in the cytsol or plastids, preferentially in the plastids, or after the expression of nucleic acid molecule or polypeptide according to the invention has been generated or increased, preferentially in the plastids, the transgenic plant generated thus is grown on or in a nutrient medium or else in the soil and subsequently harvested.

for the disclosure of the paragraphs [0102.0.0.25] to [0110.0.0.25] see paragraphs [0102.0.0.0] to [0110.0.0.0] above.

In a preferred embodiment, the fine chemical (e.g. an amino acid such as threonine) is produced in accordance with the invention and, if desired, is isolated. The production of further fine chemicals such as amino acids like lysine, methionine etc. and of fine chemical mixtures by the process according to the invention is advantageous.

for the disclosure of the paragraphs [0112.0.0.25] to [0115.0.0.25] see paragraphs [0112.0.0.0] to [0115.0.0.0] above.

In a preferred embodiment, the present invention relates to a process for the production of the fine chemical comprising or generating in an organism or a part thereof, preferably in a cell compartment such as a plastid or mitochondria, the expression of at least one nucleic acid molecule comprising a nucleic acid molecule selected from the group consisting of:

a) nucleic acid molecule encoding, preferably at least the mature form, of the polypeptide as shown in table II or IX, columns 5 and 7 or a fragment thereof, which confers an increase and/or decrease in the amount of the fine chemical in an organism or a part thereof;
b) nucleic acid molecule comprising, preferably at least the mature form, of the nucleic acid molecule shown in table I or VIII, columns 5 and 7;
c) nucleic acid molecule whose sequence can be deduced from a polypeptide sequence encoded by a nucleic acid molecule of (a) or (b) as result of the degeneracy of the genetic code and conferring an increase and/or decrease in the amount of the fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase and/or decrease in the amount of the fine chemical in an organism or a part thereof;
e) nucleic acid molecule which hybridizes with a nucleic acid molecule of (a) to (c) under stringent hybridisation conditions and conferring an increase and/or decrease in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase and/or decrease in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase and/or decrease in the amount of the fine chemical in an organism or a part thereof;
h) nucleic acid molecule comprising a nucleic acid molecule which is obtained by amplifying nucleic acid molecules from a cDNA library or a genomic library using the primers shown in table III or X, column 7 and conferring an increase and/or decrease in the amount of the fine chemical in an organism or a part thereof;

i) nucleic acid molecule which encodes a polypeptide comprising the consensus sequence having a sequences as indicated in Table IV or XI, columns 7, and having the activity of a polypeptide as defined in a) or of a polypeptide named in table XII or XIII, and conferring an increase and/or decrease in the amount of the respective fine chemical as shown in table XII or XIII in an organism or a part thereof;

j) nucleic acid molecule which encodes a polypeptide comprising the consensus sequence shown in table IV or XI, column 7 and conferring an increase and/or decrease in the amount of the fine chemical in an organism or a part thereof;

k) nucleic acid molecule comprising one or more of the nucleic acid molecule encoding the amino acid sequence of a polypeptide encoding a domain of the polypeptide shown in table II or IX, columns 5 and 7 and conferring an increase and/or decrease in the amount of the fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase and/or decrease in the amount of the fine chemical in an organism or a part thereof;

or which comprises a sequence which is complementary thereto.

In a preferred embodiment, the present invention relates to a process for the control of the production of fine chemicals comprising or generating in an organism or a part thereof the expression of at least one nucleic acid molecule comprising a nucleic acid molecule selected from the group consisting of:

a) nucleic acid molecule encoding, preferably at least the mature form, of a polypeptide having a sequence as indicated in Table II, columns 5 or 7, and selected from the group consisting of b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039, b4139, YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W, or a fragment thereof, which confers an increase or a decrease in the amount of the respective fine chemical as shown in table XII and/or XIII in an organism or a part thereof;

b) nucleic acid molecule comprising, preferably at least the mature form, of a nucleic acid molecule having a sequence as indicated in Table I or VIII, columns 5 or 7, and corresponding to the polypeptide as defined in a) and named in table XII or XIII;

c) nucleic acid molecule whose sequence can be deduced from a polypeptide sequence encoded by a nucleic acid molecule of (a) or (b) as result of the degeneracy of the genetic code and conferring an increase and/or a decrease in the amount of the respective fine chemical as shown in table XII or XIII in an organism or a part thereof;

d) nucleic acid molecule encoding a polypeptide which has at least 50% identity with the amino acid sequence of the polypeptide encoded by the nucleic acid molecule of (a) to (c) and conferring an increase and/or decrease in the amount of the respective fine chemical as shown in table XII or XIII in an organism or a part thereof;

e) nucleic acid molecule which hybridizes with a nucleic acid molecule of (a) to (c) under stringent hybridisation conditions and conferring an increase and/or a decrease in the amount of the respective fine chemical as shown in table XII or XIII in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase and/or decrease in the amount of the respective fine chemical as shown in table XII or XIII in an organism or a part thereof;

g) nucleic acid molecule encoding a fragment or an epitope of a polypeptide which is encoded by one of the nucleic acid molecules of (a) to (e), preferably to (a) to (c) and conferring an increase and/or decrease in the amount of the respective fine chemical as shown in table XII or XIII in an organism or a part thereof;

h) nucleic acid molecule comprising a nucleic acid molecule which is obtained by amplifying nucleic acid molecules from a cDNA library or a genomic library using the primers pairs having a sequence as indicated in Table III or X, columns 7, and corresponding to a polypeptide as defined in a) and named in table XII or XIII, and conferring an increase and/or decrease in the amount of the respective fine chemical as shown in table XII or XIII in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase and/or decrease in the amount of the respective fine chemical as shown in table XII or XIII in an organism or a part thereof;

j) nucleic acid molecule which encodes a polypeptide comprising the consensus sequence having a sequences as indicated in Table IV, columns 7, and corresponding to a polypeptide as defined in a) and named in table X, and conferring an increase or decrease in the amount of the respective fine chemical as shown in table X in an organism or a part thereof;

k) nucleic acid molecule comprising one or more of the nucleic acid molecule encoding the amino acid sequence of a polypeptide encoding a domain of a polypeptide indicated in Table II or IX, columns 5 or 7, and as defined in a) and named in table XII or XIII, and conferring an increase and/or decrease in the amount of the respective fine chemical as shown in table XII or XIII in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase and/or decrease in the amount of the respective fine chemical as shown in table XII or XIII in an organism or a part thereof;
or which comprises a sequence which is complementary thereto.

In one embodiment, the nucleic acid molecule used in the process of the invention distinguishes over the sequence indicated in table IA, columns 5 and 7 by one or more nucleotides. In one embodiment, the nucleic acid molecule used in the process of the invention does not consist of the sequence indicated in table IA, columns 5 and 7. In one embodiment, the nucleic acid molecule used in the process of the invention is less than 100%, 99.999%, 99.99%, 99.9% or 99% identical to a sequence indicated in table IA, columns 5 and 7. In another embodiment, the nucleic acid molecule does not encode a polypeptide of a sequence indicated in table IIA, columns 5 and 7.

In one embodiment, the nucleic acid molecule used in the process of the invention distinguishes over the sequence indicated in table IB, columns 5 and 7, by one or more nucleotides. In one embodiment, the nucleic acid molecule used in the process of the invention does not consist of the sequence indicated in table IB, columns 5 and 7. In one embodiment, the nucleic acid molecule used in the process of the invention is less than 100%, 99.999%, 99.99%, 99.9% or 99% identical to a sequence indicated in table IB, columns 5 and 7. In another embodiment, the nucleic acid molecule does not encode a polypeptide of a sequence indicated in table IIB, columns 5 and 7.

In one embodiment, the nucleic acid molecule used in the process distinguishes over the sequence shown in table I or VIII, columns 5 and 7 by one or more nucleotides or does not consist of the sequence shown in table I or VIII, columns 5 and 7. In one embodiment, the nucleic acid molecule of the present invention is less than 100%, 99.999%, 99.99%, 99.9% or 99% identical to the sequence shown in table I or VIII, columns 5 and 7. In another embodiment, the nucleic acid molecule does not encode a polypeptide of the sequence shown in table II or IX, columns 5 and 7.

for the disclosure of the paragraphs [0118.0.0.25] to [0120.0.0.25] see paragraphs [0118.0.0.0] to [0120.0.0.0] above.

Nucleic acid molecules with the sequence shown in table I or VIII, columns 5 and 7, nucleic acid molecules which are derived from the amino acid sequences shown in table II or IX, columns 5 and 7 or from polypeptides comprising the consensus sequence shown in table IV or XI, column 7, or their derivatives or homologues encoding polypeptides with the enzymatic or biological activity of a protein as shown in table II or IX, column 3 or conferring the fine chemical increase and/or decrease after increasing its expression or activity are advantageously increased in the process according to the invention by expression either in the cytsol or in an organelle such as a plastid or mitochondria or both, preferably in plastids.

for the disclosure of this paragraph see paragraph [0122.0.0.0] above.

Nucleic acid molecules, which are advantageous for the process according to the invention and which encode polypeptides with the activity of a protein as shown in table II or IX, column 3 can be determined from generally accessible databases.

for the disclosure of this paragraph see paragraph [0124.0.0.0] above.

The nucleic acid molecules used in the process according to the invention take the form of isolated nucleic acid sequences, which encode polypeptides with the activity of the proteins as shown in table II or IX, column 3 and conferring the fine chemical increase and/or decrease by expression either in the cytsol or in an organelle such as a plastid or mitochondria or both, preferably in plastids.

for the disclosure of the paragraphs [0126.0.0.25] to [0133.0.0.25] see paragraphs [0126.0.0.0] to [0133.0.0.0] above.

However, it is also possible to use artificial sequences, which differ in one or more bases from the nucleic acid sequences found in organisms, or in one or more amino acid molecules from polypeptide sequences found in organisms, in particular from the polypeptide sequences shown in table II or IX, columns 5 and 7 or the functional homologues thereof as described herein, preferably conferring above-mentioned activity, i.e. conferring the fine chemical increase and/or decrease after increasing its activity, e.g. after increasing the activity of a protein as shown in table II or IX, column 3 by for example expression either in the cytsol or in an organelle such as a plastid or mitochondria or both, preferably in plastids.

for the disclosure of the paragraphs [0135.0.0.25] to [0140.0.0.25] see paragraphs [0135.0.0.0] to [0140.0.0.0] above.

Synthetic oligonucleotide primers for the amplification, e.g. as shown in table III or X, column 7, by means of polymerase chain reaction can be generated on the basis of a sequence shown herein, for example the sequence shown in table I or VIII, columns 5 and 7 or the sequences derived from table II or IX, columns 5 and 7.

Moreover, it is possible to identify conserved regions from various organisms by carrying out protein sequence alignments with the polypeptide used in the process of the invention, in particular with sequences of the polypeptide of the invention, from which conserved regions, and in turn, degenerated primers can be derived. Conserved regions are those, which show a very little variation in the amino acid type in one particular position of several homologs from different origin. The consensus sequences for the different polypeptide sequences are shown in table IV and/or XI, column 7 are derived from said alignments.

Degenerated primers can then be utilized by PCR for the amplification of fragments of novel nucleic acids, encoding proteins having above-mentioned activity, e.g. conferring the increase and/or decrease of the fine chemical after increasing the expression or activity or having the activity of a protein as shown in table II or IX, column 3 or further functional homologs of the polypeptide of the invention from other organisms.

for the disclosure of the paragraphs [0144.0.0.25] to [0151.0.0.25] see paragraphs [0144.0.0.0] to [0151.0.0.0] above.

Polypeptides having above-mentioned activity, i.e. conferring the fine chemical increase and/or decrease, derived from other organisms, can be encoded by other DNA sequences which hybridize to the sequences shown in table I or VIII, columns 5 and 7, preferably shown in table IB, columns 5 and 7 under relaxed, preferably stringent hybridization conditions and which code on expression for peptides having the fine chemical increasing and/or decreasing activity.

for the disclosure of the paragraphs [0153.0.0.25] to [0159.0.0.25] see paragraphs [0153.0.0.0] to [0159.0.0.0] above.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I or VIII, columns 5 and 7, preferably shown in table IB, columns 5 and 7 is one which is sufficiently complementary to one of the nucleotide sequences shown in table I or VI II, columns 5 and 7, preferably shown in table IB, columns 5 and 7 such that it can hybridize to one of the nucleotide sequences shown in table I or VIII, columns 5 and 7, preferably shown in table IB, columns 5 and 7, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I or VIII, columns 5 and 7, preferably shown in table IB, columns 5 and 7, or a portion thereof and preferably has above mentioned activity, in particular having a fine chemical increasing and/or decreasing activity after increasing the activity or an activity of a gene product as shown in table II or IX, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I or VIII, columns 5 and 7, preferably shown in table IB, columns 5 and 7, or a portion thereof and encodes a protein having above-mentioned activity, e.g. conferring of a fine chemical increase and/or decrease by for example expression either in the cytsol or in an organelle such as a plastid or mitochondria or both, preferably in plastids, and optionally, the activity of a protein as shown in table II or IX, column 3.

Moreover, the nucleic acid molecule of the invention can comprise only a portion of the coding region of one of the sequences shown in table I or VIII, columns 5 and 7, preferably shown in table IB, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increase and/or decrease of the fine chemical if its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I or VIII, columns 5 and 7, an anti-sense sequence of one of the sequences, e.g., set forth in table I or VIII, columns 5 and 7, preferably shown in table IB, columns 5 and 7, or naturally occurring mutants thereof. Primers based on a nucleotide of invention can be used in PCR reactions to clone homologues of the nucleic acids sequences encoding the polypeptide of the invention or of the polypeptide used in the process of the invention, e.g. as the primers described in the examples of the present invention, e.g. as shown in the examples. A PCR with the primers shown in table III or X, column 7 will result in a fragment of the gene product as shown in table II or IX, column 3 when using the appropriate template DNA and PCR conditions.

for the disclosure of this paragraph see paragraph [0164.0.0.0] above.

The nucleic acid molecule of the invention encodes a polypeptide or portion thereof which includes an amino acid sequence which is sufficiently homologous to the amino acid sequence shown in table II or IX, columns 5 and 7 such that the protein or portion thereof maintains the ability to participate in the fine chemical modification or production, in particular a fine chemical increasing and/or decreasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II or IX, columns 5 and 7 such that the protein or portion thereof is able to participate in the increase and/or decrease of the fine chemical production, for examples having the activity of a protein as shown in table II or IX, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II or IX, columns 5 and 7 and having above-mentioned activity, e.g. conferring preferably the increase and/or decrease of the fine chemical by for example expression either in the cytsol or in an organelle such as a plastid or mitochondria or both, preferably in plastids.

for the disclosure of the paragraphs [0168.0.0.25] and [0169.0.0.25] see paragraphs [0168.0.0.0] to [0169.0.0.0] above.

The invention further relates to nucleic acid molecules that differ from one of the nucleotide sequences shown in table I or VIII, columns 5 and 7 (and portions thereof) due to degeneracy of the genetic code and thus encode a polypeptide of the present invention, in particular a polypeptide having above mentioned activity, e.g. conferring an increase and/or decrease in the fine chemical in a organism, e.g. as that polypeptides depicted by the sequence shown in table II or IX, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II or IX, columns 5 and 7 or the functional homologues. In a still further embodiment, the nucleic acid molecule of the invention encodes a full length protein which is substantially homologous to an amino acid sequence shown in table II or IX, columns 5 and 7 or the functional homologues. However, in a preferred embodiment, the nucleic acid molecule of the present invention does not consist of the sequence shown in table I or VIII, columns 5 and 7, preferably as indicated in table IA, columns 5 and 7. Preferably the nucleic acid molecule of the invention is a functional homologue or identical to a nucleic acid molecule indicated in table IB, columns 5 and 7.

for the disclosure of the paragraphs [0171.0.0.25] to [0173.0.0.25] see paragraphs [0171.0.0.0] to [0173.0.0.0] above.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I or VIII, columns 5 and 7. The nucleic acid molecule is preferably at least 20, 30, 50, 100, 250 or more nucleotides in length.

for the disclosure of this paragraph see paragraph [0175.0.0.0] above.

Preferably, nucleic acid molecule of the invention that hybridizes under stringent conditions to a sequence shown in table I or VIII, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase and/or decrease after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

for the disclosure of this paragraph see paragraph [0177.0.0.0] above.

For example, nucleotide substitutions leading to amino acid substitutions at "non-essential" amino acid residues can be made in a sequence of the nucleic acid molecule of the invention or used in the process of the invention, e.g. shown in table I or VIII, columns 5 and 7.

for the disclosure of the paragraphs [0179.0.0.25] and [0180.0.0.25] see paragraphs [0179.0.0.0] and [0180.0.0.0] above.

Accordingly, the invention relates to nucleic acid molecules encoding a polypeptide having above-mentioned activity, e.g. conferring an increase and/or decrease in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II or IX, columns 5 and 7, preferably shown in table IIA, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II or IX, columns 5 and 7, preferably shown in table IIA, columns 5 and 7 and is capable of participation in the increase and/or decrease of the production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II or IX, columns 5 and 7, preferably shown in table IIA, columns 5 and 7, more preferably at least about 70% identical to one of the sequences shown in table II or IX, columns 5 and 7, preferably shown in table IIA, columns 5 and 7, even more preferably at least about 80%, 90%, 95% homologous to the sequence shown in table II or IX, columns 5 and 7, and most preferably at least about 96%, 97%, 98%, or 99% identical to the sequence shown in table II or IX, columns 5 and 7, preferably shown in table IIA, columns 5 and 7.

for the disclosure of the paragraphs [0182.0.0.25] to [0188.0.0.25] see paragraphs [0182.0.0.0] to [0188.0.0.0] above.

Functional equivalents derived from one of the polypeptides as shown in table II or IX, columns 5 and 7, preferably shown in table IIB, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II or IX, columns 5 and 7, preferably shown in table IIB, columns 5 and 7 resp., according to the invention and are distinguished by essentially the same properties as the polypeptide as shown in table II or IX, columns 5 and 7, preferably shown in table IIB, columns 5 and 7.

Functional equivalents derived from the nucleic acid sequence as shown in table I or VIII, columns 5 and 7, preferably shown in table IB, columns 5 and 7 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II or IX, columns 5 and 7, preferably shown in table IIB, columns 5 and 7 resp., according to the invention and encode polypeptides having essentially the same properties as the polypeptide as shown in table II or IX, columns 5 and 7, preferably shown in table IIB, columns 5 and 7.

for the disclosure of this paragraph see paragraph [0191.0.0.0] above.

A nucleic acid molecule encoding an homologous to a protein sequence of table II or IX, columns 5 and 7, preferably shown in table IIB, columns 5 and 7 resp., can be created by introducing one or more nucleotide substitutions, additions or deletions into a nucleotide sequence of the nucleic acid molecule of the present invention, in particular of table I or VIII, columns 5 and 7, preferably shown in table IB, columns 5 and 7 resp., such that one or more amino acid substitutions, additions or deletions are introduced into the encoded protein. Mutations can be introduced into the encoding sequences of table I or VIII, columns 5 and 7, preferably shown in table IB, columns 5 and 7 resp., by standard techniques, such as site-directed mutagenesis and PCR-mediated mutagenesis.

for the disclosure of the paragraphs [0193.0.0.25] to [0196.0.0.25] see paragraphs [0193.0.0.0] to [0196.0.0.0] above.

Homologues of the nucleic acid sequences used, with the sequence shown in table I or VIII, columns 5 and 7, preferably shown in table IB, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I or VIII, columns 5 and 7, preferably shown in table IB, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I or VIII, columns 5 and 7, preferably shown in table IB, columns 5 and 7. It is preferred that the nucleic acid molecule comprises as little as possible other nucleotides not shown in any one of table I or VIII, columns 5 and 7, preferably shown in table IB, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I or VIII, columns 5 and 7, preferably shown in table IB, columns 5 and 7.

Also preferred is that the nucleic acid molecule used in the process of the invention encodes a polypeptide comprising the sequence shown in table II or IX, columns 5 and 7, preferably shown in table IIB, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II or IX, columns 5 and 7, preferably shown in table IIB, columns 5 and 7.

In one embodiment, the nucleic acid molecule of the invention or used in the process encodes a polypeptide comprising the sequence shown in table II or IX, columns 5 and 7, preferably shown in table IIB, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I or VIII, columns 5 and 7, preferably shown in table IB, columns 5 and 7.

Polypeptides (=proteins), which still have the essential biological or enzymatic activity of the polypeptide of the present invention conferring an increase and/or decrease of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II or IX, columns 5 and 7 expressed under identical conditions.

Homologues of table I or VIII, columns 5 and 7 or of the derived sequences of table II or IX, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

for the disclosure of the paragraphs [0203.0.0.25] to [0215.0.0.25] see paragraphs [0203.0.0.0] to [0215.0.0.0] above.

Accordingly, in one embodiment, the invention relates to a nucleic acid molecule, which comprises a nucleic acid molecule selected from the group consisting of:

a) nucleic acid molecule encoding, preferably at least the mature form, of the polypeptide shown in table II or IX, columns 5 and 7; preferably shown in Table IIB, columns 5 and 7, or a fragment thereof conferring an increase and/or decrease in the amount of the fine chemical in an organism or a part thereof b) nucleic acid molecule comprising, preferably at least the mature form, of the nucleic acid molecule shown in table I or VIII, columns 5 and 7 preferably shown in Table IB, columns 5 and 7, or a fragment thereof conferring an increase and/or decrease in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase and/or decrease in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase and/or decrease in the amount of the fine chemical in an organism or a part thereof;

e) nucleic acid molecule which hybridizes with a nucleic acid molecule of (a) to (c) under stringent hybridisation conditions and conferring an increase and/or decrease in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase and/or decrease in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase and/or decrease in the amount of the fine chemical in an organism or a part thereof;

h) nucleic acid molecule comprising a nucleic acid molecule which is obtained by amplifying a cDNA library or a genomic library using the primers in table III or X, column 7 and conferring an increase and/or decrease in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase and/or decrease in the amount of the fine chemical in an organism or a part thereof;

j) nucleic acid molecule which encodes a polypeptide comprising the consensus sequence shown in table IV or XI, columns 7 and conferring an increase and/or decrease in the amount of the fine chemical in an organism or a part thereof;
k) nucleic acid molecule encoding the amino acid sequence of a polypeptide encoding a domain of the polypeptide shown in table II or IX, columns 5 and 7 and conferring an increase and/or decrease in the amount of the fine chemical in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule shown in table I or VIII, columns 5 and 7 or a nucleic acid molecule encoding, preferably at least the mature form of, the polypeptide shown in table II or IX, columns 5 and 7, and conferring an increase and/or decrease in the amount of the fine chemical in an organism or a part thereof; or which encompasses a sequence which is complementary thereto;

Accordingly, the invention relates to nucleic acid molecules encoding a polypeptide having above-mentioned activity, e.g. conferring an increase and/or decrease in the fine chemical in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II or IX, columns 5 and 7, preferably shown in table IIA, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II or IX, columns 5 and 7, preferably shown in table IIA, columns 5 and 7 and is capable of participation in the increase and/or decrease of the production of the fine chemical after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II or IX, columns 5 and 7, preferably shown in table IIA, columns 5 and 7, more preferably at least about 70% identical to one of the sequences shown in table II or IX, columns 5 and 7, preferably shown in table IIA, columns 5 and 7, even more preferably at least about 80%, 90%, 95% homologous to the sequence shown in table II or IX, columns 5 and 7, and most preferably at least about 96%, 97%, 98%, or 99% identical to the sequence shown in table II or IX, columns 5 and 7, preferably shown in table IIA, columns 5 and 7.

for the disclosure of the paragraphs [0217.0.0.25] to [0226.0.0.25] see paragraphs [0217.0.0.0] to [0226.0.0.0] above.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451. The vectors are preferably modified in such a manner, that they already contain the nucleic acid coding for the transitpeptide and that the nuleic acids of the invention, preferentially the nucleic acid sequences encoding the polypeptides shown in table II or IX, columns 5 and 7 can be cloned 3'prime to the transitpeptide encoding sequence, leading to a functional preprotein, which is directed to the plastids and which means that the mature protein fulfills its biological activity, preferentially in the plastids.

for the disclosure of the paragraphs [0228.0.0.25] to [0239.0.0.25] see paragraphs [0228.0.0.0] to [0239.0.0.0] above.

In addition to the sequence mentioned in table I or VIII, columns 5 and 7 or its derivatives, it is advantageous additionally to express and/or mutate further genes in the organisms. Especially advantageously, additionally at least one further gene of the desired fine chemical such as of the amino acid biosynthetic pathway such as for L-lysine, L-threonine and/or L-methionine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased and/or decreased that means a modified synthesis of the fine chemical such as amino acids desired since, for example, feedback regulations no longer exist to the same extent or not at all. In addition it might be advantageously to combine the nucleic acids sequences of the invention containing the sequences shown in table I or VIII, columns 5 and 7 with genes which generally support or enhances to growth or yield of the target organism, for example genes which lead to faster growth rate of microorganisms or genes which produces stress-, pathogen, or herbicide resistant plants.

for the disclosure of the paragraphs [0241.0.0.25] to [0264.0.0.25] see paragraphs [0241.0.0.0] to [0264.0.0.0] above.

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular preferred are sequences, which are involved in targeting to plastids as mentioned above. Sequences, which must be mentioned in this context are, in particular, the signal-peptide- or transit-peptide-encoding sequences which are known per se. For example, plastid transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention as shown in table I or VIII, columns 5 and 7 and described herein to achieve an expression in one of said compartments or extracellular.

for the disclosure of the paragraphs [0266.0.0.25] to [0287.0.0.25] see paragraphs [0266.0.0.0] to [0287.0.0.0] above.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host. A further preferred embodiment of the invention relates to a vector in which a nucleic acid sequence encoding one of the polypeptides shown in table II or IX, columns 5 and 7 or their homologs is functionally linked to a plastidial targeting sequence. A further preferred embodiment of the invention relates to a vector in which a nucleic acid sequence encoding one of the polypeptides shown in table II IX, columns 5 and 7 or their homologs is functionally linked to a regulatory sequences which permit the expression in plastids. A further preferred embodiment of the invention relates to a vector in which a nucleic acid sequence encoding one of the polypeptides shown in table II, IX, columns 5 and 7 or their homologs is linked to sequences enabling the integration of the nucleic acid sequence encoding one of the polypeptides shown in table II, IX, columns 5 and 7 into an organell genome, preferably the plastidal genome.

for the disclosure of the paragraphs [0289.0.0.25] to [0296.0.0.25] see paragraphs [0289.0.0.0] to [0296.0.0.0] above.

Moreover, native polypeptides conferring the increase of the fine chemical in an organism or part thereof can be isolated from cells (e.g., endothelial cells), for example using the antibody of the present invention as described below, in particular, an anti-b0342, anti-b0403, anti-b0488, anti-b0598, anti-b0644, anti-b0720, anti-b0760, anti-b0855, anti-b0931, anti-b1046, anti-b1062, anti-b1095, anti-b1131, anti-b1136, anti-b1184, anti-b1223, anti-b1264, anti-b1277, anti-b1410, anti-b1551, anti-b1556, anti-b1625, anti-b1627, anti-b1640, anti-b1700, anti-b1704, anti-b1732, anti-b1758, anti-b1868, anti-b1933, anti-b1980, anti-b2022, anti-b2040, anti-b2066, anti-b2223, anti-b2284, anti-b2312, anti-b2344, anti-b2366, anti-b2600, anti-b2601, anti-b2818, anti-b2827, anti-b2965, anti-b3117, anti-b3213, anti-b3390, anti-b3429, anti-b3443, anti-b3568, anti-b3616, anti-b3708, anti-b3728, anti-b3770, anti-b4039, anti-b4139, anti-YAL038W, anti-YBL082C, anti-YBR001C, anti-YDR035W, anti-YDR430C, anti-YDR497C, anti-YEL046C, anti-YER024W, anti-YGL065C, anti-YGL126W, anti-YGR255C, anti-YGR262C, anti-YGR289C, anti-YHR204W, anti-YIR020W-B, anti-YJL139C, anti-YJR073C, anti-YKR043C, anti-YLL033W, anti-YLR027C, anti-YLR099C, anti-YLR153C, anti-YLR174W, anti-YMR262W, anti-YNL022C, anti-YNL241C, anti-YNR012W, anti-YOL126C, anti-YOR350C, anti-YOR353C, anti-YPL080C and/or anti-YPR035W protein antibody or an antibody against polypeptides as shown in table II or IX, columns 5 and 7, which can be produced by standard techniques utilizing the polypeptide of the present invention or fragment thereof, i.e., the polypeptide of this invention. Preferred are monoclonal antibodies.

for the disclosure of this paragraph see paragraph [0298.0.0.0] above.

In one embodiment, the present invention relates to a polypeptide having the sequence shown in table II or IX, columns 5 and 7 or as coded by the nucleic acid molecule shown in table I or VI II, columns 5 and 7 or functional homologues thereof.

In one advantageous embodiment, in the method of the present invention the activity of a polypeptide is increased comprising or consisting of the consensus sequence shown in table IV or XI, columns 7 and in one another embodiment, the present invention relates to a polypeptide comprising or consisting of the consensus sequence shown in table IV or XI, columns 7 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

for the disclosure of the paragraphs [0301.0.0.25] to [0304.0.0.25] see paragraphs [0301.0.0.0] to [0304.0.0.0] above.

In one advantageous embodiment, the method of the present invention comprises the increasing of a polypeptide comprising or consisting of plant or microorganism specific consensus sequences.

In one embodiment, said polypeptide of the invention distinguishes over the sequence shown in table IIA and/or IIB, columns 5 and 7 by one or more amino acids. In one embodiment, polypeptide distinguishes form the sequence shown in table IIA and/or II B, columns 5 and 7 by more than 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from the sequence shown in table II or IX, columns 5 and 7 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence shown in table II or IX, columns 5 and 7.

for the disclosure of this paragraph see paragraph [0306.0.0.0] above.

In one embodiment, the invention relates to polypeptide conferring an increase and/or decrease in the fine chemical in an organism or part being encoded by the nucleic acid molecule of the invention or used in the process of the invention and having a sequence which distinguishes from the sequence as shown in table IIA and/or IIB or IX, columns 5 and 7 by one or more amino acids. In another embodiment, said polypeptide of the invention does not consist of the sequence shown in table IIA and/or IIB or IX, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB or VIII, columns 5 and 7.

In one embodiment, the invention relates to polypeptide conferring an increase and/or decrease in the fine chemical in an organism or part being encoded by the nucleic acid molecule of the invention or used in the process of the invention and having a sequence which distinguishes from the sequence as shown in table IIA and/or IIB or IX, columns 5 and 7 by one or more amino acids. In another embodiment, said polypeptide of the invention does not consist of the sequence shown in table IIA and/or IIB or IX, columns 5 and 7. In a further embodiment, said polypeptide of the present invention is less than 100%, 99.999%, 99.99%, 99.9% or 99% identical. In one embodiment, said polypeptide does not consist of the sequence encoded by the nucleic acid molecules shown in table IA and/or IB or VIII, columns 5 and 7.

for the disclosure of the paragraphs [0309.0.0.25] to [0311.0.0.25] see paragraphs [0309.0.0.0] to [0311.0.0.0] above.

A polypeptide of the invention can participate in the process of the present invention. The polypeptide or a portion thereof comprises preferably an amino acid sequence, which is sufficiently homologous to an amino acid sequence shown in table IIA and/or IIB or table IX, columns 5 and 7.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences as shown in table IIA and/or IIB or IX, columns 5 and 7. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of table IA and/or IB or VIII, columns 5 and 7 or which is homologous thereto, as defined above.

Accordingly the polypeptide of the present invention can vary from the sequences shown in table IIA and/or IIB or IX, columns 5 and 7 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence shown in table IIA and/or IIB or IX, columns 5 and 7.

for the disclosure of this paragraph see paragraph [0315.0.0.0] above.

Biologically active portions of an polypeptide of the present invention include peptides comprising amino acid sequences derived from the amino acid sequence of the polypeptide of the present invention or used in the process of the present invention, e.g., the amino acid sequence shown in table II or IX, columns 5 and 7 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

for the disclosure of this paragraph see paragraph [0317.0.0.0] above.

Manipulation of the nucleic acid molecule of the invention may result in the production of a protein having differences from the wild-type protein as shown in table II or IX, column 5. Differences shall mean at least one amino acid different from the sequences as shown in table II or IX, column 5, preferably at least 2, 3, 4, 5, 6, 7, 8, 9 or 10 amino acids, more preferably at least 15, 20, 25, 30, 35, 40, 45 or 50 amino acids different from the sequences as shown in table II or IX, column 5. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins or mutated proteins of the proteins as shown in table II or IX, column 3 or 5. The nucleic acid molecules and polypeptide molecules of the invention are expressed such that the yield, production, and/or efficiency of production of a desired compound is improved.

for the disclosure of the paragraphs [0320.0.0.25] to [0322.0.0.25] see paragraphs [0320.0.0.0] to [0322.0.0.0] above.

In one embodiment, a protein (=polypeptide) as shown in table II or IX, column 3 refers to a polypeptide having an amino acid sequence corresponding to the polypeptide of the invention or used in the process of the invention, whereas a "non-inventive protein or polypeptide" or "other polypeptide" refers to a polypeptide having an amino acid sequence corresponding to a protein which is not substantially homologous to a polypeptide of the invention, preferably which is not substantially homologous to a polypeptide or protein as shown in table II or IX, column 3, e.g., a protein which does not confer the activity described herein and which is derived from the same or a different organism.

for the disclosure of the paragraphs [0324.0.0.25] to [0329.0.0.25] see paragraphs [0324.0.0.0] to [0329.0.0.0] above.

In an especially preferred embodiment, the polypeptide according to the invention furthermore also does not have the sequences of those proteins which are encoded by the sequences shown in table II or IX, columns 5 and 7.

for the disclosure of the paragraphs [0331.0.0.25] to [0346.0.0.25] see paragraphs [0331.0.0.0] to [0346.0.0.0] above.

Accordingly the present invention relates to any cell transgenic for any nucleic acid characterized as part of the invention, e.g. conferring the increase and/or decrease of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having an activity as the protein as shown in table II or IX, column 3. Due to the above mentioned activity the fine chemical content in a cell or an organism is increased and/or decreased. For example, due to modulation or manipulation, the cellular activity is increased preferably in organelles such as plastids or mitochondria, e.g. due to an increased expression or specific activity or specific targeting of the subject matters of the invention in a cell or an organism or a part thereof especially in organelles such as plastids or mitochondria. Transgenic for a polypeptide having a protein or activity means herein that due to modulation or manipulation of the genome, the activity of protein as shown in table II o IX, column 3 or a protein as shown in table II or IX, column 3-like activity is increased in the cell or organism or part thereof especially in organelles such as plastids or mitochondria. Examples are described above in context with the process of the invention.

for the disclosure of this paragraph see paragraph [0348.0.0.0] above.

A naturally occurring expression cassette—for example the naturally occurring combination of the promoter of the gene encoding a protein as shown in table II or IX, column 3 with the corresponding encoding gene—becomes a transgenic expression cassette when it is modified by non-natural, synthetic "artificial" methods such as, for example, mutagenization. Such methods have been described (U.S. Pat. No. 5,565,350; WO 00/15815; also see above).

for the disclosure of the paragraphs [0350.0.0.25] to [0369.0.0.25] see paragraphs [0350.0.0.0] to [0369.0.0.0] above.

The fermentation broths obtained in this way, containing in particular the fine chemical such as amino acids like L-methionine, L-threonine and/or L-lysine preferably L-threonine, normally have a dry matter content of from 7.5 to 25% by weight. The fermentation broth can be processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

for the disclosure of the paragraphs [0371.0.0.25] to [0376.0.0.25], [0376.1.0.25] and [0377.0.0.25] see paragraphs [0371.0.0.0] to [0376.0.0.0], [0376.1.0.0] and [0377.0.0.0] above.

In one embodiment, the present invention relates to a method for the identification of a gene product conferring an increase in the fine chemical production in a cell, comprising the following steps:
a) contacting e.g. hybridising, the nucleic acid molecules of a sample, e.g. cells, tissues, plants or microorganisms or a nucleic acid library, which can contain a candidate gene encoding a gene product conferring an increase and/or decrease in the fine chemical after expression, with the nucleic acid molecule of the present invention;
b) identifying the nucleic acid molecules, which hybridize under relaxed stringent conditions with the nucleic acid molecule of the present invention in particular to the nucleic acid molecule sequence shown in table I or VIII, columns 5 and 7, preferably in table IB, columns 5 and 7, and, optionally, isolating the full length cDNA clone or complete genomic clone;
c) introducing the candidate nucleic acid molecules in host cells, preferably in a plant cell or a microorganism, appropriate for producing the fine chemical;
d) expressing the identified nucleic acid molecules in the host cells;
e) assaying the fine chemical level in the host cells; and
f) identifying the nucleic acid molecule and its gene product which expression confers an increase and/or decrease in the fine chemical level in the host cell after expression compared to the wild type.

for the disclosure of this paragraph see paragraph [0379.0.0.0] above.

In another embodiment, the present invention relates to a method for the identification of a gene product conferring an increase and/or decrease in the fine chemical production in a cell, comprising the following steps:
a) identifying nucleic acid molecules of an organism; which can contain a candidate gene encoding a gene product conferring an increase and/or decrease in the fine chemical after expression, which are at least 20%, preferably 25%, more preferably 30%, even more preferred are 35%. 40% or 50%, even more preferred are 60%, 70% or 80%, most preferred are 90% or 95% or more homology to the nucleic acid molecule of the present invention, for example via homology search in a data bank;
b) introducing the candidate nucleic acid molecules in host cells, preferably in a plant cells or microorganisms, appropriate for producing the fine chemical;
c) expressing the identified nucleic acid molecules in the host cells;
d) assaying the fine chemical level in the host cells; and
e) identifying the nucleic acid molecule and its gene product which expression confers an increase and/or decrease in the fine chemical level in the host cell after expression compared to the wild type.

for the disclosure of this paragraph see paragraph [0381.0.0.0] above.

Furthermore, in one embodiment, the present invention relates to a method for the identification of a compound stimulating or repressing production of the fine chemical to said plant comprising:
a) contacting cells which express the polypeptide of the present invention or its mRNA with a candidate compound under cell cultivation conditions;
b) assaying an increase in expression of said polypeptide or said mRNA;
c) comparing the expression level to a standard response made in the absence of said candidate compound; whereby, an increased expression over the standard indicates that the compound is stimulating production of the fine chemical or whereby, a decreased expression over the standard indicates that the compound is repressing production of the fine chemical.

Furthermore, in one embodiment, the present invention relates to process for the identification of a compound conferring increased and/or decreased the fine chemical production in a plant or microorganism, comprising the steps:
a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and
b) identifying if the compound is an effective agonist by detecting the presence or absence or increase of a signal produced by said readout system.

The screen for a gene product or an agonist conferring an increase and/or decrease in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase and/or decrease in fine chemical production. One can think to screen for increased fine chemical production by for example resistance to drugs blocking fine chemical synthesis and looking whether this effect is dependent on the proteins as shown in table II or IX, column 3, e.g. comparing near identical organisms with low and high activity of the proteins as shown in table II or IX, column 3.

for the disclosure of the paragraphs [0385.0.0.25] to [0398.0.0.25] see paragraphs [0385.0.0.0] to [0398.0.0.0] above.

Accordingly, the present invention relates to a method for breeding plants for the modified production of the fine chemical, comprising
a) providing a first plant variety produced according to the process of the invention preferably expressing or overexpressing the nucleic acid molecule of the invention;
b) crossing the first plant variety with a second plant variety; and
c) selecting the offspring plants which produce or overproduce or produce to a lower extend the fine chemical by means of analysis the distribution of a molecular marker in the offspring representing the first plant variety and its capability to produce or overproduce the fine chemical.

In another embodiment, the process according to the invention comprises the following steps:
a) introducing of a nucleic acid construct comprising the nucleic acid molecule of the invention or used in the process of the invention or encoding the polypeptide of the present invention or used in the process of the invention; or
b) introducing of a nucleic acid molecule, including regulatory sequences or factors, which expression increases the expression of the nucleic acid molecule of the invention or used in the process of the invention or encoding the polypeptide of the present invention or used in the process of the invention; in a cell, or an organism or a part thereof, preferably in a plant, plant cell or a microorganism, preferably in the plastids of plants, and
c) expressing of the gene product encoded by the nucleic acid construct or the nucleic acid molecule mentioned under (a) or (b) in the cell or the organism.

In a further embodiment the present invention relates to a method for the generation of a host or host cell, e.g. transgenic, showing a metabolic profile as depicted in any one of the columns of table XIII or showing a reduction of fine chemicals as listed in table XII.

In a further embodiment the present invention relates to a method for the generation of a transgenic host or host cell showing a metabolic profile as depicted in any one of the columns of table XIII and expressing an nucleic acid or a polypeptide of the invention or use in the method of the invention.

In a further embodiment the present invention relates to a method for the generation of a transgenic host or host cell showing a metabolic profile 30% similar to a profile as depicted in any one of the columns of table XIII and expressing the protein displayed in the respective column of table XIII or a homolog thereof.

In a further embodiment the present invention relates to a method for the generation of a transgenic host or host cell showing a metabolic profile 50%, more preferred, 60%, even more preferred 70%, even more preferred 80% or even more preferred 90%, 91%, 92%, 93%, 94%, 95%, 96%, 97%, 98%, 99% similar to a profile as depicted in any one of the columns of table XIII and expressing the protein displayed in the respective column of table XIII or a homolog thereof. % similarity is the above described context of metabolic profiles is to be understood, that this percentage of metabolic changes occur also in the transgenic host or host cell in the same direction. For example a 80% similar metabolic profile displays 8 of 10 metabolic changes in the same direction as depicted in any column of table XIII.

The process of the present invention may be used for improving the quality of foodstuffs and animal feeds, which is an important task of the food-and-feed industry. Especially advantageous for the quality of foodstuffs and animal feeds is as balanced as possible an metabolic profile since a great excess of one fine chemical above a specific concentration in the food has no further positive effect on the utilization of the food since another fine chemical suddenly become limiting.

The manufacturing of high quality foodstuffs and animal feeds is possible by the process of the present invention, which controls the production of each fine chemical as depicted in table XIII.

The process of the present invention stand for an inexpensive process for the synthesis of a combination of fine chemicals such as amino acids, fatty acids, carbohydrates, vitamins, phytostyrols, coenzymes, organic acids, carotenoids, preferably as mentioned in table XIII, at the same time in an sufficient amount to provide optimal growth and health benefit to animals or humans.

The products manufactured by the process of the present invention can be used or can be incorporated without great and expensive efforts as high quality food, nutraceuticals, feed or additives there for.

The fine chemical or the combination of fine chemicals obtained in the process is suitable as starting material for the synthesis of further products of value. For example, they can be used in combination with other ingredients or alone for the production of nutraceuticals, pharmaceuticals, foodstuffs, animal feeds or cosmetics.

Accordingly, the present invention relates a method for the production of a nutraceutical, pharmaceuticals, food stuff, animal feeds, nutrients or cosmetics comprising the steps of the process according to the invention, including the isolation of the fine chemical or fine chemical composition produced and if desired formulating the product with a pharmaceutical acceptable carrier or formulating the product in a form acceptable for an application in agriculture.

A further embodiment according to the invention is the use of the fine chemical produced in the process or of the transgenic organisms in animal feeds, foodstuffs, medicines, food supplements, cosmetics or pharmaceuticals.

In one embodiment the process of the invention is used for the production of feed or functional feed by overexpressing in a host cell the nucleic acid sequence coding for the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039, b4139, YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W-protein, or homologues thereof in a organism, microorganism or a plant, preferentially in a organelle of a plant, more preferred in the plastids of a plant and isolating the fine chemical or the combination of fine chemicals, preferably the combination of amino acid or using the host cell as feed without isolation of certain fine chemicals.

In a further embodiment the process of the invention is used for the production of feed or functional feed by overexpressing in a host cell the nucleic acid sequence coding for the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039, b4139, YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W-protein or homolgous thereof in a organism, microorganism or a plant, preferentially in a organelle of a plant, more preferred in the plastids of a plant and using the host cell as feed containing an enhanced amino acid profile. Enhanced amino acid profile means that one or more amino acid, which in plants are limited with regard to the supply of mammals, are increased in there amount.

More preferably, the nucleic acid sequence coding for the b0342, b0403, b0488, b0598, b0644, b0720, b0760, b0855, b0931, b1046, b1062, b1095, b1131, b1136, b1184, b1223, b1264, b1277, b1410, b1551, b1556, b1625, b1627, b1640, b1700, b1704, b1732, b1758, b1868, b1933, b1980, b2022, b2040, b2066, b2223, b2284, b2312, b2344, b2366, b2600, b2601, b2818, b2827, b2965, b3117, b3213, b3390, b3429, b3443, b3568, b3616, b3708, b3728, b3770, b4039, b4139, YAL038W, YBL082C, YBR001C, YDR035W, YDR430C, YDR497C, YEL046C, YER024W, YGL065C, YGL126W, YGR255C, YGR262C, YGR289C, YHR204W, YIR020W-B, YJL139C, YJR073C, YKR043C, YLL033W, YLR027C, YLR099C, YLR153C, YLR174W, YMR262W, YNL022C, YNL241C, YNR012W, YOL126C, YOR350C, YOR353C, YPL080C and/or YPR035W-protein, or homologues thereof are used, hence they confer an increase and/or decrease in the fine chemical preferably in amino acids and in fatty acids, organic acids, vitamins, phytosterols and saccharides.

Generally, the preparations produced according to the present invention can contribute as additives or compounds in the treatment of health disorders like high blood cholesterol levels, high triglycerides levels, high blood fibrinogen levels, HDL/LDL ratio, diabetes, metabolic syndrome, menopausal or post-menopausal conditions, hormone related disorders, vision disorders, inflammatory disorders, immune disorders, liver diseases, chronic hepatitis, steatosis, phospholipid deficiency, lipid peroxidation, dysrhythmia of cell regeneration, destabilization of cell membranes, coronary artery disease, high blood pressure, cancer, hypertension, aging, kidney disease, skin diseases, edema, gastrointestinal diseases, peripheral vascular system diseases, allergies, neurodegenerative and psychiatric diseases.

The nutraceuticals can be formulated for administration by inhalation or insufflation (either through the mouth or the nose) or oral, buccal, parenteral or rectal administration. For oral administration, the nutraceuticals can be added directly to foods so that the nutraceuticals are ingested during normal meals. Any methods known to those skilled in the art may be used to add or incorporate nutraceuticals to natural or processed foods.

Generally, the preparations produced according to the present invention may be introduced in dairy products like biscuits, soy products, bakery, pastry and bread, sauces, soups, prepared foods, frozen foods, condiments, confectionary, oils and fats, margarines, spreads, fillings, salad dressings, cereals, instant products, teas, drinks and shakes, infant formulas, infant foods (biscuits, mashed vegetables and fruits, cereals), bars, extruded and/or puffed snack foods, candies, ice-creams, chocolate products, and/or products containing corn sweeteners, cereals, chips, puddings, candies, and breads.

Generally, the preparations produced according to the present invention may be introduced in cosmetics.

The process of the present invention is further used for the production of cosmeceuticals, a term which refers to personal care products that contain substances that exert beneficial effects such as anti-wrinkle, antioxidant, skin conditioning, analgesia, sun protection, stimulation of hair growth. Furthermore, they may also impart a desirable physiological effect such as stimulation of microcirculation. Anti-ageing is a key target area, this includes antioxidants and sun protection, which also help to prevent diseases such as skin cancer.

According to the present invention, the term "metabolic profile" encompasses and implies also a decrease of one or more fine chemicals as disclosed in each line of table XII.

The sequence of b0001 from *Escherichia coli* K12 has been published in Blattner et al., Science 277(5331), 1453-1474, 1997, and its activity is being defined as a thr operon leader peptide. Accordingly, in one embodiment, the process of the present invention comprises the use of a gene product with an activity of the *Escherichia coli* thr operon leader peptide activity or its homolog, e.g. as shown herein, from *Escherichia coli* K12 or its homolog, e.g. as shown herein, for a decrease of the fine chemical, meaning of Coenzyme Q9, Isoleucine, Leucine, Phenylalanine, Succinate and/or Tyrosine in a range as indicated in Table XII, in free or bound form in an organism or a part thereof, as mentioned.

In another embodiment, in the process of the present invention the activity of a b0001 protein is increased or generated in a subcellular compartment of the organism or organism cell such as in an organelle like a plastid or mitochondria.

The sequence of b0002 from *Escherichia coli* K12 has been published in Blattner et al., Science 277(5331), 1453-1474, 1997, and its activity is being defined as a thrA bifunctional enzyme. Accordingly, in one embodiment, the process of the present invention comprises the use of a gene product with an activity of the *Escherichia coli* thrA bifunctional enzyme, preferably a protein with a thrA bifunctional enzyme activity or its homolog, e.g. as shown herein, from *Escherichia coli* K12 or its homolog, e.g. as shown herein, for a decrease of the fine chemical, meaning of ctramalate and/or galactolipids in a range as indicated in Table XII, in free or bound form in an organism or a part thereof, as mentioned.

In another embodiment, in the process of the present invention the activity of a b0002 protein is increased or generated in a subcellular compartment of the organism or organism cell such as in an organelle like a plastid or mitochondria.

The sequence of b0025 from *Escherichia coli* K12 has been published in Blattner et al., Science 277(5331), 1453-1474, 1997, and its activity is being defined as a probable regulator ribF. Accordingly, in one embodiment, the process of the present invention comprises the use of a gene product with an activity of the *Escherichia coli* probable regulator ribF, preferably a protein with a probable regulator ribF activity or its homolog, e.g. as shown herein, from *Escherichia coli* K12 or its homolog, e.g. as shown herein, for a decrease of the fine chemical, meaning of 5-Oxoproline, Shikimic acid, Sinapic acid and/or Succinate in a range as indicated in Table XII, in free or bound form in an organism or a part thereof, as mentioned.

In another embodiment, in the process of the present invention the activity of a b0025 protein is increased or generated in a subcellular compartment of the organism or organism cell such as in an organelle like a plastid or mitochondria.

The sequence of b0215 from *Escherichia coli* K12 has been published in Blattner et al., Science 277(5331), 1453-1474, 1997, and its activity is being defined as a DNA-directed DNA polymerase. Accordingly, in one embodiment, the process of the present invention comprises the use of a gene product with an activity of the *Escherichia coli* DNA-directed DNA polymerase, preferably a protein with a DNA-directed DNA polymerase activity or its homolog, e.g. as shown herein, from *Escherichia coli* K12 or its homolog, e.g. as shown herein, for a decrease of the fine chemical, meaning of glutamate and/or threonic acid in a range as indicated in Table XII, in free or bound form in an organism or a part thereof, as mentioned.

In another embodiment, in the process of the present invention the activity of a b0215 protein is increased or generated in a subcellular compartment of the organism or organism cell such as in an organelle like a plastid or mitochondria.

The sequence of b0388 from *Escherichia coli* K12 has been published in Blattner et al., Science 277(5331), 1453-1474, 1997, and its activity is being defined as a shikimate kinase protein. Accordingly, in one embodiment, the process of the present invention comprises the use of a gene product with an activity of the *Escherichia coli* shikimate kinase, preferably a protein with a shikimate kinase activity or its homolog, e.g. as shown herein, from *Escherichia coli* K12 or its homolog, e.g. as shown herein, for a decrease of the fine chemical, meaning of shikimic acid in a range as indicated in Table XII, in free or bound form in an organism or a part thereof, as mentioned.

In another embodiment, in the process of the present invention the activity of a b0388 protein is increased or generated in a subcellular compartment of the organism or organism cell such as in an organelle like a plastid or mitochondria.

The sequence of b1929 from *Escherichia coli* K12 has been published in Blattner et al., Science 277(5331), 1453-1474, 1997, and its activity has been defined as a prutative inner membrane protein. Accordingly, in one embodiment, the process of the present invention comprises the use of a gene product with an activity of a predicted inner membrane protein from *E. coli* K12 or its homolog, e.g. as shown herein, for a decrease of the fine chemical, meaning of tryptophane in a range as indicated in Table XII, in free or bound form in an organism or a part thereof, as mentioned.

In another embodiment, in the process of the present invention the activity of a b1939 protein is increased or generated in a subcellular compartment of the organism or organism cell such as in an organelle like a plastid or mitochondria.

The sequence of b2156 from *Escherichia coli* K12 has been published in Blattner et al., Science 277(5331), 1453-1474, 1997, and its activity is being defined as a lysine transporter. Accordingly, in one embodiment, the process of the present invention comprises the use of a gene product with an activity of the *Escherichia coli* lysine transporter activity or its homolog, e.g. as shown herein, from *Escherichia coli* K12 or its homolog, e.g. as shown herein, for a decrease of the fine chemical, meaning of shikimic acid in a range as indicated in Table XII, in free or bound form in an organism or a part thereof, as mentioned.

In another embodiment, in the process of the present invention the activity of a b2156 protein is increased or generated in a subcellular compartment of the organism or organism cell such as in an organelle like a plastid or mitochondria.

The sequence of b2238 from *Escherichia coli* K12 has been published in Blattner et al., Science 277(5331), 1453-1474, 1997, and its activity is being defined as a hypothetical 7.5 kD protein in inaA-glpQ intergenic region. Accordingly, in one embodiment, the process of the present invention comprises the use of a gene product with an activity of the aforementioned *Escherichia coli* protein or its homolog, e.g. as shown herein, from *Escherichia coli* K12 or its homolog, e.g. as shown herein, for a decrease of the fine chemical, meaning of galactolipids in a range as indicated in Table XII, in free or bound form in an organism or a part thereof, as mentioned.

In another embodiment, in the process of the present invention the activity of a b2238 protein is increased or generated in a subcellular compartment of the organism or organism cell such as in an organelle like a plastid or mitochondria.

The sequence of b2466 from *Escherichia coli* K12 has been published in Blattner et al., Science 277(5331), 1453-1474, 1997, and its activity is being defined as a uncharacterized protein. Accordingly, in one embodiment, the process of the present invention comprises the use of a gene product with an activity of said putative *Escherichia coli* protein or its homolog, e.g. as shown herein, from *Escherichia coli* K12 or its homolog, e.g. as shown herein, for a decrease of the fine chemical, meaning of Leucine in a range as indicated in Table XII, in free or bound form in an organism or a part thereof, as mentioned.

In another embodiment, in the process of the present invention the activity of a b2466 protein is increased or generated in a subcellular compartment of the organism or organism cell such as in an organelle like a plastid or mitochondria.

The sequence of b2478 from *Escherichia coli* K12 has been published in Blattner et al., Science 277(5331), 1453-1474, 1997, and its activity has been defined as a dihydrodipicolinate synthase. Accordingly, in one embodiment, the process of the present invention comprises the use of a gene product with an activity of a dihydrodipicolinate synthase from *E. coli* K12 or its homolog, e.g. as shown herein, for a decrease of the fine chemical, meaning of threonine in a range as indicated in Table XII, in free or bound form in an organism or a part thereof, as mentioned.

In another embodiment, in the process of the present invention the activity of a b2478 protein is increased or generated in a subcellular compartment of the organism or organism cell such as in an organelle like a plastid or mitochondria.

The sequence of b2554 from *Escherichia coli* K12 has been published in Blattner et al., Science 277(5331), 1453-1474, 1997, and its activity is being defined as a predicted DNA-binding response regulator in two-component system. Accordingly, in one embodiment, the process of the present invention comprises the use of a gene product with an activity of the *Escherichia coli* DNA-binding response regulator activity or its homolog, e.g. as shown herein, from *Escherichia coli* K12 or its homolog, e.g. as shown herein, for a decrease of the fine chemical, meaning of fumarate, raffinose and/or succinate in a range as indicated in Table XII, in free or bound form in an organism or a part thereof, as mentioned.

In another embodiment, in the process of the present invention the activity of a b2554 protein is increased or generated in a subcellular compartment of the organism or organism cell such as in an organelle like a plastid or mitochondria.

The sequence of b2998 from *Escherichia coli* K12 has been published in Blattner et al., Science 277(5331), 1453-1474, 1997, and its activity has been defined as a uncharacterized protein. Accordingly, in one embodiment, the process of the present invention comprises the use of a gene product with an activity of a said uncharacterized protein from *E. coli* K12 or its homolog, e.g. as shown herein, for a decrease of the fine chemical, meaning of leucine in a range as indicated in Table XII, in free or bound form in an organism or a part thereof, as mentioned.

In another embodiment, in the process of the present invention the activity of a b2998 protein is increased or generated in a subcellular compartment of the organism or organism cell such as in an organelle like a plastid or mitochondria.

The sequence of b3077 from *Escherichia coli* K12 has been published in Blattner et al., Science 277(5331), 1453-1474, 1997, and its activity is being defined as a cryptic beta-D-galactosidase (beta subunit). Accordingly, in one embodiment, the process of the present invention comprises the use of a gene product with an activity of the *Escherichia coli* cryptic beta-D-galactosidase (beta subunit) activity or its homolog, e.g. as shown herein, from *Escherichia coli* K12 or its homolog, e.g. as shown herein, for a decrease of the fine chemical, meaning of isopentenyl pyrophosphate in a range as indicated in Table XII, in free or bound form in an organism or a part thereof, as mentioned.

In another embodiment, in the process of the present invention the activity of a b3077 protein is increased or generated in a subcellular compartment of the organism or organism cell such as in an organelle like a plastid or mitochondria.

The sequence of b3120 from *Escherichia coli* K12 has been published in Blattner et al., Science 277(5331), 1453-1474, 1997, and its activity is being defined as a uncharacterized protein. Accordingly, in one embodiment, the process of the present invention comprises the use of a gene product with an activity of said uncharacterized *Escherichia coli* protein or its homolog, e.g. as shown herein, from *Escherichia coli* K12 or its homolog, e.g. as shown herein, for a decrease of the fine chemical, meaning of glycerol, hexadecatrienoic acid and/or glactolipids in a range as indicated in Table XII, in free or bound form in an organism or a part thereof, as mentioned.

In another embodiment, in the process of the present invention the activity of a b3120 protein is increased or generated in a subcellular compartment of the organism or organism cell such as in an organelle like a plastid or mitochondria.

The sequence of b3216 from *Escherichia coli* K12 has been published in Blattner et al., Science 277(5331), 1453-1474, 1997, and its activity has been defined as a outer membrane usher protein. Accordingly, in one embodiment, the process of the present invention comprises the use of a gene product with an activity of outer membrane usher protein from *E. coli* K12 or its homolog, e.g. as shown herein, for a decrease of the fine chemical, meaning of verbascose in a range as indicated in Table XII, in free or bound form in an organism or a part thereof, as mentioned.

In another embodiment, in the process of the present invention the activity of a b3216 protein is increased or generated in a subcellular compartment of the organism or organism cell such as in an organelle like a plastid or mitochondria.

The sequence of b3509 from *Escherichia coli* K12 has been published in Blattner et al., Science 277(5331), 1453-1474, 1997, and its activity is being defined as a protein hdeB precursor. Accordingly, in one embodiment, the process of the present invention comprises the use of a gene product with an activity of the *Escherichia coli* protein hdeB precursor activity or its homolog, e.g. as shown herein, from *Escherichia coli* K12 or its homolog, e.g. as shown herein, for a decrease of the fine chemical, meaning of oleic acid in a range as indicated in Table XII, in free or bound form in an organism or a part thereof, as mentioned.

In another embodiment, in the process of the present invention the activity of a b3509 protein is increased or generated in a subcellular compartment of the organism or organism cell such as in an organelle like a plastid or mitochondria.

The sequence of b3598 from *Escherichia coli* K12 has been published in Blattner et al., Science 277(5331), 1453-1474, 1997, and its activity is being defined as a uncharacterized protein. Accordingly, in one embodiment, the process of the present invention comprises the use of a gene product with an activity of said uncharacterized *Escherichia coli* protein or its homolog, e.g. as shown herein, for a decrease of the fine chemical, meaning of verbascose in a range as indicated in Table XII, in free or bound form in an organism or a part thereof, as mentioned.

In another embodiment, in the process of the present invention the activity of a b3598 protein is increased or generated in a subcellular compartment of the organism or organism cell such as in an organelle like a plastid or mitochondria.

The sequence of b3974 from *Escherichia coli* K12 has been published in Blattner et al., Science 277(5331), 1453-1474, 1997, and its activity is being defined as a pantothenate kinase. Accordingly, in one embodiment, the process of the present invention comprises the use of a gene product with an activity of the *Escherichia coli* pantothenate kinase activity or its homolog, e.g. as shown herein, from *Escherichia coli* K12 or its homolog, e.g. as shown herein, for a decrease of the fine chemical, meaning of tryptophane in a range as indicated in Table XII, in free or bound form in an organism or a part thereof, as mentioned.

In another embodiment, in the process of the present invention the activity of a b3974 protein is increased or generated in a subcellular compartment of the organism or organism cell such as in an organelle like a plastid or mitochondria.

The sequence of b0488 (Accession number NP_415021) from *Escherichia coli* K12 has been published in Blattner et al., Science 277(5331), 1453-1474, 1997, and its activity is being defined as a conserved inner membrane protein. Accordingly, in one embodiment, the process of the present invention comprises the use of a gene product with an activity of the *Escherichia coli* conserved inner membrane protein activity or its homolog, e.g. as shown herein, from *Escherichia coli* K12 or its homolog, e.g. as shown herein, for a decrease of the fine chemical, meaning of ferulic acid in a range as indicated in Table XII, in free or bound form in an organism or a part thereof, as mentioned.

In another embodiment, in the process of the present invention the activity of a b0488 protein is increased or generated in a subcellular compartment of the organism or organism cell such as in an organelle like a plastid or mitochondria.

The sequence of b0598 from *Escherichia coli* K12 has been published in Blattner et al., Science 277(5331), 1453-1474, 1997, and its activity is being defined as a carbon starvation protein. Accordingly, in one embodiment, the process of the present invention comprises the use of a gene product with an activity of the *Escherichia coli* carbon starvation protein or its homolog, e.g. as shown herein, for a decrease of the fine chemical, meaning of glycerol and/or galactolipids in a range as indicated in Table XII, in free or bound form in an organism or a part thereof, as mentioned.

In another embodiment, in the process of the present invention the activity of a b0598 protein is increased or generated in a subcellular compartment of the organism or organism cell such as in an organelle like a plastid or mitochondria.

The sequence of b0644 from *Escherichia coli* K12 has been published in Blattner et al., Science 277(5331), 1453-1474, 1997, and its activity is being defined as a uncharacterized protein. Accordingly, in one embodiment, the process of the present invention comprises the use of a gene product with an activity of said uncharacterized the *Escherichia coli* protein or its homolog, e.g. as shown herein, from *Escherichia coli* K12 or its homolog, e.g. as shown herein, for a decrease of the fine chemical, meaning of 5-Oxoproline, Aspartate, Tyrosine, Citramalate, Malate, Succinate, Sinapic acid, Sucrose and/or Glycerol in a range as indicated in Table XII, in free or bound form in an organism or a part thereof, as mentioned.

In another embodiment, in the process of the present invention the activity of a b0644 protein is increased or generated in a subcellular compartment of the organism or organism cell such as in an organelle like a plastid or mitochondria.

The sequence of b0855 from *Escherichia coli* K12 has been published in Blattner et al., Science 277(5331), 1453-1474, 1997, and its activity is being defined as a ATP-binding component of putrescine transport system. Accordingly, in one embodiment, the process of the present invention comprises the use of a gene product with an activity of the *Escherichia coli* ATP-binding component of putrescine transport system or its homolog, e.g. as shown herein, from *Escherichia coli* K12 or its homolog, e.g. as shown herein, for a decrease of the fine chemical, meaning of phenylalanine, tyrosine, ferulic acid and/or glycerol in a range as indicated in Table XII, in free or bound form in an organism or a part thereof, as mentioned.

In another embodiment, in the process of the present invention the activity of a b0855 protein is increased or generated in a subcellular compartment of the organism or organism cell such as in an organelle like a plastid or mitochondria.

The sequence of b0931 from *Escherichia coli* K12 has been published in Blattner et al., Science 277(5331), 1453-1474, 1997, and its activity has been defined as a nicotinate phosphoribosyltransferase. Accordingly, in one embodiment, the process of the present invention comprises the use of a gene product with an activity of a nicotinate phosphoribosyltransferase from *E. coli* K12 or its homolog, e.g. as shown herein, for a decrease of the fine chemical, meaning of glycine in a range as indicated in Table XII, in free or bound form in an organism or a part thereof, as mentioned.

In another embodiment, in the process of the present invention the activity of a b0931 protein is increased or generated in a subcellular compartment of the organism or organism cell such as in an organelle like a plastid or mitochondria.

The sequence of b1184 from *Escherichia coli* K12 has been published in Blattner et al., Science 277(5331), 1453-1474, 1997, and its activity has been defined as a protein involved in the SOS mutagenesis and repair. Accordingly, in one embodiment, the process of the present invention comprises the use of a gene product with an activity of said protein from *E. coli* K12 or its homolog, e.g. as shown herein, for a decrease of the fine chemical, meaning of tyrosine, fumarate and/or glucose in a range as indicated in Table XII, in free or bound form in an organism or a part thereof, as mentioned.

In another embodiment, in the process of the present invention the activity of a b1184 protein is increased or generated in a subcellular compartment of the organism or organism cell such as in an organelle like a plastid or mitochondria.

The sequence of b1223 from *Escherichia coli* K12 has been published in Blattner et al., Science 277(5331), 1453-1474, 1997, and its activity is being defined as a nitrite extrusion protein. Accordingly, in one embodiment, the process of the present invention comprises the use of a gene product with an activity of the *Escherichia coli* nitrite extrusion protein activity or its homolog, e.g. as shown herein, from *Escherichia coli* K12 or its homolog, e.g. as shown herein, for a decrease of the fine chemical, meaning of succinate in a range as indicated in Table XII, in free or bound form in an organism or a part thereof, as mentioned.

In another embodiment, in the process of the present invention the activity of a b1223 protein is increased or generated in a subcellular compartment of the organism or organism cell such as in an organelle like a plastid or mitochondria.

The sequence of b1277 from *Escherichia coli* K12 has been published in Blattner et al., Science 277(5331), 1453-1474, 1997, and its activity is being defined as a GTP cyclohydrolase II protein. Accordingly, in one embodiment, the process of the present invention comprises the use of a gene product with an activity of the *Escherichia coli* GTP cyclohydrolase II protein activity or its homolog, e.g. as shown herein, from *Escherichia coli* K12 or its homolog, e.g. as shown herein, for a decrease of the fine chemical, meaning of shikimic acid and/or beta-apo-8 carotenal in a range as indicated in Table XII, in free or bound form in an organism or a part thereof, as mentioned.

In another embodiment, in the process of the present invention the activity of a b1277 protein is increased or generated in a subcellular compartment of the organism or organism cell such as in an organelle like a plastid or mitochondria.

The sequence of b1551 from *Escherichia coli* K12 has been published in Blattner et al., Science 277(5331), 1453-1474, 1997, and its activity is being defined as a Qin prophage. Accordingly, in one embodiment, the process of the present invention comprises the use of a gene product with an activity of the *Escherichia coli* Qin prophage or its homolog, e.g. as shown herein, from *Escherichia coli* K12 or its homolog, e.g. as shown herein, for a decrease of the fine chemical, meaning of glutamine in a range as indicated in Table XII, in free or bound form in an organism or a part thereof, as mentioned.

In another embodiment, in the process of the present invention the activity of a b1551 protein is increased or generated in a subcellular compartment of the organism or organism cell such as in an organelle like a plastid or mitochondria.

The sequence of b1556 from *Escherichia coli* K12 has been published in Blattner et al., Science 277(5331), 1453-1474, 1997, and its activity has been defined as a Qin prophage. Accordingly, in one embodiment, the process of the present invention comprises the use of a gene product with an activity of a Qin prophage from *E. coli* K12 or its homolog, e.g. as shown herein, for a decrease of the fine chemical, meaning of Alanine, Glycine, Serine, Shikimic acid, Glycerolphosphate, lipid fraction and/or Salicylic acid in a range as indicated in Table XII, in free or bound form in an organism or a part thereof, as mentioned.

In another embodiment, in the process of the present invention the activity of a b1556 protein is increased or generated in a subcellular compartment of the organism or organism cell such as in an organelle like a plastid or mitochondria.

The sequence of b1704 from *Escherichia coli* K12 has been published in Blattner et al., Science 277(5331), 1453-1474, 1997, and its activity has been defined as a 3-deoxy-D-arabinoheptulosonate-7-phosphate synthase. Accordingly, in one embodiment, the process of the present invention comprises the use of a gene product with an activity of a 3-deoxy-D-arabinoheptulosonate-7-phosphate synthase from *E. coli* K12 or its homolog, e.g. as shown herein, for a decrease of the fine chemical, meaning of threonine, glutamate, hexadecadienoic acid and/or fumarate in a range as indicated in Table XII, in free or bound form in an organism or a part thereof, as mentioned.

In another embodiment, in the process of the present invention the activity of a b1704 protein is increased or generated in a subcellular compartment of the organism or organism cell such as in an organelle like a plastid or mitochondria.

The sequence of b1732 from *Escherichia coli* K12 has been published in Blattner et al., Science 277(5331), 1453-1474, 1997, and its activity has been defined as a catalase. Accordingly, in one embodiment, the process of the present invention comprises the use of a gene product with an activity of a catalase from *E. coli* K12 or its homolog, e.g. as shown herein, for a decrease of the fine chemical, meaning of gamma-tocoperol/beta-tocopherol/2,3-dimethyl-5-phytylquinol, glycerol-3-phosphate and/or glycerolphosphate in a range as indicated in Table XII, in free or bound form in an organism or a part thereof, as mentioned.

In another embodiment, in the process of the present invention the activity of a b1732 protein is increased or generated in a subcellular compartment of the organism or organism cell such as in an organelle like a plastid or mitochondria.

The sequence of b2600 from *Escherichia coli* K12 has been published in Blattner et al., Science 277(5331), 1453-1474, 1997, and its activity has been defined as a chorismate mutase T. Accordingly, in one embodiment, the process of the present invention comprises the use of a gene product with an activity of a chorismate mutase T from *E. coli* K12 or its homolog, e.g. as shown herein, for a decrease of the fine chemical, meaning of tryptophane in a range as indicated in Table XII, in free or bound form in an organism or a part thereof, as mentioned.

In another embodiment, in the process of the present invention the activity of a b2600 protein is increased or generated in a subcellular compartment of the organism or organism cell such as in an organelle like a plastid or mitochondria.

The sequence of b2965 from *Escherichia coli* K12 has been published in Blattner et al., Science 277(5331), 1453-1474, 1997, and its activity has been defined as a ornithine decarboxylase. Accordingly, in one embodiment, the process of the present invention comprises the use of a gene product with an activity of a ornithine decarboxylase from *E. coli* K12 or its homolog, e.g. as shown herein, for a decrease of the fine chemical, meaning of Stearic acid (C18:0), Campesterol, Threonine, Citrulline, Fumarate, Shikimic acid and/or myo-Inositol in a range as indicated in Table XII, in free or bound form in an organism or a part thereof, as mentioned.

In another embodiment, in the process of the present invention the activity of a b2965 protein is increased or generated in a subcellular compartment of the organism or organism cell such as in an organelle like a plastid or mitochondria.

The sequence of b3390 from *Escherichia coli* K12 has been published in Blattner et al., Science 277(5331), 1453-1474, 1997, and its activity has been defined as a shikimate kinase 1. Accordingly, in one embodiment, the process of the present invention comprises the use of a gene product with an activity of a shikimate kinase I from *E. coli* K12 or its homolog, e.g. as shown herein, for a decrease of the fine chemical, meaning of shikimic acid in a range as indicated in Table XII, in free or bound form in an organism or a part thereof, as mentioned.

In another embodiment, in the process of the present invention the activity of a b3390 protein is increased or generated in a subcellular compartment of the organism or organism cell such as in an organelle like a plastid or mitochondria.

The sequence of b3616 from *Escherichia coli* K12 has been published in Blattner et al., Science 277(5331), 1453-1474, 1997, and its activity has been defined as a L-threonine 3-dehydrogenase. Accordingly, in one embodiment, the process of the present invention comprises the use of a gene product with an activity of a L-threonine 3-dehydrogenase from *E. coli* K12 or its homolog, e.g. as shown herein, for a decrease of the fine chemical, meaning of methionine, threonine, shikimic acid and/or sinapic acid in a range as indicated in Table XII, in free or bound form in an organism or a part thereof, as mentioned.

In another embodiment, in the process of the present invention the activity of a b3616 protein is increased or generated in a subcellular compartment of the organism or organism cell such as in an organelle like a plastid or mitochondria.

The sequence of b3770 from *Escherichia coli* K12 has been published in Blattner et al., Science 277(5331), 1453-1474, 1997, and its activity has been defined as a branched-chain amino acid aminotransferase. Accordingly, in one embodiment, the process of the present invention comprises the use of a gene product with an activity of a branched-chain amino acid aminotransferase from *E. coli* K12 or its homolog, e.g. as shown herein, for a decrease of the fine chemical, meaning of leucine in a range as indicated in Table XII, in free or bound form in an organism or a part thereof, as mentioned.

In another embodiment, in the process of the present invention the activity of a b3770 protein is increased or generated in a subcellular compartment of the organism or organism cell such as in an organelle like a plastid or mitochondria.

The sequence of b4139 from *Escherichia coli* K12 has been published in Blattner et al., Science 277(5331), 1453-1474, 1997, and its activity has been defined as a aspartate ammonia-lyase. Accordingly, in one embodiment, the process of the present invention comprises the use of a gene product with an activity of a aspartate ammonia-lyase from *E. coli* K12 or its homolog, e.g. as shown herein, for a decrease of the fine chemical, meaning of threonine, glutamate, glyceric acid, malate, pyruvate and/or succinate in a range as indicated in Table XII, in free or bound form in an organism or a part thereof, as mentioned.

In another embodiment, in the process of the present invention the activity of a b4139 protein is increased or generated in a subcellular compartment of the organism or organism cell such as in an organelle like a plastid or mitochondria.

The sequence of YBR177C from *Saccharomyces cerevisiae* has been published in Feldmann et al, EMBO J. 13 (24), 5795-5809 (1994), and its activity has been defined as a Acyl-coenzymeA:ethanol O-acyltransferase (alcohol acyl transferase). Accordingly, in one embodiment, the process of the present invention comprises the use of a gene product with an activity of a Acyl-coenzymeA:ethanol O-acyltransferase from *Saccharomyces cerevisiae* or its homolog, e.g. as shown herein, for a decrease of the fine chemical, meaning of 5-oxo-proline, glutamate and/or glycinein a range as indicated in Table XII, in free or bound form in an organism or a part thereof, as mentioned.

In another embodiment, in the process of the present invention the activity of a YBR177C protein is increased or generated in a subcellular compartment of the organism or organism cell such as in an organelle like a plastid or mitochondria.

The sequence of YBR281C from *Saccharomyces cerevisiae* has been published in Feldmann et al, EMBO J. 13 (24), 5795-5809 (1994), and its activity has been defined as a uncharacterized protein. Accordingly, in one embodiment, the process of the present invention comprises the use of a gene product with an activity of a said uncharacterized protein from *Saccharomyces cerevisiae* or its homolog, e.g. as shown herein, for a decrease of the fine chemical, meaning of glycine in a range as indicated in Table XII, in free or bound form in an organism or a part thereof, as mentioned.

In another embodiment, in the process of the present invention the activity of a YBR281 C protein is increased or generated in a subcellular compartment of the organism or organism cell such as in an organelle like a plastid or mitochondria.

The sequence of YDL222C from *Saccharomyces cerevisiae* has been published in Jacq et al, Nature 387 (6632 SUPPL), 75-78 (1997), and its activity has been defined as a uncharacterized membrane protein. Accordingly, in one embodiment, the process of the present invention comprises the use of a gene product with an activity of a said uncharacterized membrane protein from *Saccaromyces cerevisiae* or its homolog, e.g. as shown herein, for a decrease of the fine chemical, meaning of sucrose in a range as indicated in Table XII, in free or bound form in an organism or a part thereof, as mentioned.

In another embodiment, in the process of the present invention the activity of a YDL222C protein is increased or generated in a subcellular compartment of the organism or organism cell such as in an organelle like a plastid or mitochondria.

The sequence of YDR127W from *Saccharomyces cerevisiae* has been published in Jacq et al, Nature 387 (6632 SUPPL), 75-78 (1997), and its activity has been defined as a pentafunctional arom protein. Accordingly, in one embodiment, the process of the present invention comprises the use of a gene product with an activity of a pentafunctional arom protein from *Saccharomyces cerevisiae* or its homolog, e.g. as shown herein, for a decrease of the fine chemical, meaning of zeaxanthin in a range as indicated in Table XII, in free or bound form in an organism or a part thereof, as mentioned.

In another embodiment, in the process of the present invention the activity of a YDR127W protein is increased or generated in a subcellular compartment of the organism or organism cell such as in an organelle like a plastid or mitochondria.

The sequence of YDR206W from *Saccharomyces cerevisiae* has been published in Jacq et al, Nature 387 (6632 SUPPL), 75-78 (1997), and its activity has been defined as a uncharacterized protein. Accordingly, in one embodiment, the process of the present invention comprises the use of a gene product with an activity of a said uncharacterized protein from *Saccharomyces cerevisiae* or its homolog, e.g. as shown herein, for a decrease of the fine chemical, meaning of succinate in a range as indicated in Table XII, in free or bound form in an organism or a part thereof, as mentioned.

In another embodiment, in the process of the present invention the activity of a YDR206W protein is increased or generated in a subcellular compartment of the organism or organism cell such as in an organelle like a plastid or mitochondria.

The sequence of YDR531W from *Saccharomyces cerevisiae* has been published in Jacq et al, Nature 387 (6632 SUPPL), 75-78 (1997), and its activity has been defined as a pantothenate kinase. Accordingly, in one embodiment, the process of the present invention comprises the use of a gene product with an activity of a pantothenate kinase from *Saccaromyces cerevisiae* or its homolog, e.g. as shown herein, for a decrease of the fine chemical, meaning of myo-inositol and/or sucrose in a range as indicated in Table XII, in free or bound form in an organism or a part thereof, as mentioned.

In another embodiment, in the process of the present invention the activity of a YDR531W protein is increased or generated in a subcellular compartment of the organism or organism cell such as in an organelle like a plastid or mitochondria.

The sequence of YER061 C from *Saccharomyces cerevisiae* has been published in Goffeau et al, Science 274 (5287), 546-547 (1996), and its activity has been defined as a mitochondrial beta-keto-acyl synthase. Accordingly, in one embodiment, the process of the present invention comprises the use of a gene product with an activity of a mitochondrial beta-keto-acyl synthase from *Saccharomyces cerevisiae* or its homolog, e.g. as shown herein, for a decrease of the fine chemical, meaning of succinate in a range as indicated in Table XII, in free or bound form in an organism or a part thereof, as mentioned.

In another embodiment, in the process of the present invention the activity of a YER061 C protein is increased or generated in a subcellular compartment of the organism or organism cell such as in an organelle like a plastid or mitochondria.

The sequence of YER145C from *Saccharomyces cerevisiae* has been published in Goffeau et al, Science 274 (5287), 546-547 (1996), and its activity has been defined as a high affinity iron permease. Accordingly, in one embodiment, the process of the present invention comprises the use of a gene product with an activity of a high affinity iron permeasefrom *Saccharomyces cerevisiae* or its homolog, e.g. as shown herein, for a decrease of the fine chemical, meaning of 5-oxo-proline in a range as indicated in Table XII, in free or bound form in an organism or a part thereof, as mentioned.

In another embodiment, in the process of the present invention the activity of a YER145C protein is increased or generated in a subcellular compartment of the organism or organism cell such as in an organelle like a plastid or mitochondria.

The sequence of YGL039W from *Saccharomyces cerevisiae* has been published in Tettelin et al, Nature 387 (6632 SUPPL), 81-84 (1997), and its activity has been defined as an oxidoreductase. Accordingly, in one embodiment, the process of the present invention comprises the use of a gene product with an activity of an oxidoreductase from *Saccaromyces cerevisiae* or its homolog, e.g. as shown herein, for a decrease of the fine chemical, meaning of glycerol, glycerolphosphate and/or succinate in a range as indicated in Table XII, in free or bound form in an organism or a part thereof, as mentioned.

In another embodiment, in the process of the present invention the activity of a YGL039W protein is increased or generated in a subcellular compartment of the organism or organism cell such as in an organelle like a plastid or mitochondria.

The sequence of YGR130C from *Saccharomyces cerevisiae* has been published in Tettelin et al, Nature 387 (6632 SUPPL), 81-84 (1997), and its activity has been defined as a uncharacterized protein. Accordingly, in one embodiment, the process of the present invention comprises the use of a gene product with an activity of said uncharacterized protein from *Saccaromyces cerevisiae* or its homolog, e.g. as shown herein, for a decrease of the fine chemical, meaning of sinapic acid in a range as indicated in Table XII, in free or bound form in an organism or a part thereof, as mentioned.

In another embodiment, in the process of the present invention the activity of a YGR130C protein is increased or generated in a subcellular compartment of the organism or organism cell such as in an organelle like a plastid or mitochondria.

The sequence of YGR197C from *Saccharomyces cerevisiae* has been published in Tettelin et al, Nature 387 (6632 SUPPL), 81-84 (1997), and its activity has been defined as a uncharacterized protein. Accordingly, in one embodiment, the process of the present invention comprises the use of a gene product with an activity of said uncharacterized protein from *Saccaromyces cerevisiae* or its homolog, e.g. as shown herein, for a decrease of the fine chemical, meaning of Alanine, Glyceric acid, Glycine, Serine and/or Threonine in a range as indicated in Table XII, in free or bound form in an organism or a part thereof, as mentioned.

In another embodiment, in the process of the present invention the activity of a YGR197C protein is increased or generated in a subcellular compartment of the organism or organism cell such as in an organelle like a plastid or mitochondria.

The sequence of YHL020C from *Saccharomyces cerevisiae* has been published in Goffeau et al, Science 274 (5287), 546-547 (1996), and its activity has been defined as a transcriptional regulator protein. Accordingly, in one embodiment, the process of the present invention comprises the use of a gene product with an activity of a transcriptional regulator protein from *Saccaromyces cerevisiae* or its homolog, e.g. as shown herein, for a decrease of the fine chemical, meaning of gamma-Tocopherol/beta-Tocopherol/2,3-Dimethyl-5-phytylquinol, glycerol, hexadecadienoic acid, Hexadecatrienoic acid and/or glactolipids in a range as indicated in Table XII, in free or bound form in an organism or a part thereof, as mentioned.

In another embodiment, in the process of the present invention the activity of a YHL020C protein is increased or generated in a subcellular compartment of the organism or organism cell such as in an organelle like a plastid or mitochondria.

The sequence of YHL032C from *Saccharomyces cerevisiae* has been published in Goffeau et al, Science 274 (5287), 546-547 (1996), and its activity has been defined as a glycerol kinase. Accordingly, in one embodiment, the process of the present invention comprises the use of a gene product with an activity of a glycerol kinase protein from *Saccharomyces cerevisiae* or its homolog, e.g. as shown herein, for a decrease of the fine chemical, meaning of phenylalanine, shikimic acid and/or tyrosine in a range as indicated in Table XII, in free or bound form in an organism or a part thereof, as mentioned.

In another embodiment, in the process of the present invention the activity of a YHL032C protein is increased or generated in a subcellular compartment of the organism or organism cell such as in an organelle like a plastid or mitochondria.

The sequence of YHR137W from *Saccharomyces cerevisiae* has been published in Goffeau et al, Science 274 (5287), 546-547 (1996), and its activity has been defined as an aromatic aminotransferase. Accordingly, in one embodiment, the process of the present invention comprises the use of a gene product with an activity of an aromatic aminotransferase protein from *Saccharomyces cerevisiae* or its homolog, e.g. as shown herein, for a decrease of the fine chemical, meaning of shikimic acid in a range as indicated in Table XII, in free or bound form in an organism or a part thereof, as mentioned.

In another embodiment, in the process of the present invention the activity of a YHR137W protein is increased or generated in a subcellular compartment of the organism or organism cell such as in an organelle like a plastid or mitochondria.

The sequence of YIL014W from *Saccharomyces cerevisiae* has been published in Goffeau et al, Science 274 (5287), 546-547 (1996), and its activity has been defined as an alpha-1,3-mannosyltransferase. Accordingly, in one embodiment, the process of the present invention comprises the use of a gene product with an activity of an alpha-1,3-mannosyltransferase protein from *Saccharomyces cerevisiae* or its homolog, e.g. as shown herein, for a decrease of the fine chemical, meaning of glycerolphosphate in a range as indicated in Table XII, in free or bound form in an organism or a part thereof, as mentioned.

In another embodiment, in the process of the present invention the activity of a YIL014W protein is increased or generated in a subcellular compartment of the organism or organism cell such as in an organelle like a plastid or mitochondria.

The sequence of YJL126W from *Saccharomyces cerevisiae* has been published in Goffeau et al, Science 274 (5287), 546-547 (1996), and its activity has been defined as a Nit protein. Accordingly, in one embodiment, the process of the present invention comprises the use of a gene product with an activity of a Nit protein from *Saccharomyces cerevisiae* or its homolog, e.g. as shown herein, for a decrease of the fine chemical, meaning of alanine and/or isoleucine in a range as indicated in Table XII, in free or bound form in an organism or a part thereof, as mentioned.

In another embodiment, in the process of the present invention the activity of a YJL126W protein is increased or generated in a subcellular compartment of the organism or organism cell such as in an organelle like a plastid or mitochondria.

The sequence of YJL144W from *Saccharomyces cerevisiae* has been published in Goffeau et al, Science 274 (5287), 546-547 (1996), and its activity has been defined as a Cytoplasmic hydrophilin. Accordingly, in one embodiment, the process of the present invention comprises the use of a gene product with an activity of a Cytoplasmic hydrophilin from *Saccharomyces cerevisiae* or its homolog, e.g. as shown herein, for a decrease of the fine chemical, meaning of shikimic acid and/or succinate in a range as indicated in Table XII, in free or bound form in an organism or a part thereof, as mentioned.

In another embodiment, in the process of the present invention the activity of a YJL144W protein is increased or generated in a subcellular compartment of the organism or organism cell such as in an organelle like a plastid or mitochondria.

The sequence of YLR193C from *Saccharomyces cerevisiae* has been published in Goffeau et al, Science 274 (5287), 546-547 (1996), and its activity has been defined as a uncharacterized protein. Accordingly, in one embodiment, the process of the present invention comprises the use of a gene product with an activity of said uncharacterizedprotein from *Saccharomyces cerevisiae* or its homolog, e.g. as shown herein, for a decrease of the fine chemical, meaning of hexadecadenoic acid and/or glactolipids in a range as indicated in Table XII, in free or bound form in an organism or a part thereof, as mentioned.

In another embodiment, in the process of the present invention the activity of a YLR193C protein is increased or generated in a subcellular compartment of the organism or organism cell such as in an organelle like a plastid or mitochondria.

The sequence of YNL029C from *Saccharomyces cerevisiae* has been published in Goffeau et al, Science 274 (5287), 546-547 (1996), and its activity has been defined as a mannosyltransferase. Accordingly, in one embodiment, the process of the present invention comprises the use of a gene product with an activity of a mannosyltransferase from *Saccaromyces cerevisiae* or its homolog, e.g. as shown herein, for a decrease of the fine chemical, meaning of glycerol in a range as indicated in Table XII, in free or bound form in an organism or a part thereof, as mentioned.

In another embodiment, in the process of the present invention the activity of a YNL029C protein is increased or generated in a subcellular compartment of the organism or organism cell such as in an organelle like a plastid or mitochondria.

The sequence of YOL058W from *Saccharomyces cerevisiae* has been published in Goffeau et al, Science 274 (5287), 546-547 (1996), and its activity has been defined as an arginosuccinate synthetase. Accordingly, in one embodiment, the process of the present invention comprises the use of a gene product with an activity of an arginosuccinate synthetase from *Saccaromyces cerevisiae* or its homolog, e.g. as shown herein, for a decrease of the fine chemical, meaning of citrulline and/or glycerol in a range as indicated in Table XII, in free or bound form in an organism or a part thereof, as mentioned.

In another embodiment, in the process of the present invention the activity of a YOL058W protein is increased or generated in a subcellular compartment of the organism or organism cell such as in an organelle like a plastid or mitochondria.

The sequence of YOL059W from *Saccharomyces cerevisiae* has been published in Goffeau et al, Science 274 (5287), 546-547 (1996), and its activity has been defined as a NAD-dependent glycerol 3-phosphate dehydrogenase. Accordingly, in one embodiment, the process of the present invention comprises the use of a gene product with an activity of a NAD-dependent glycerol 3-phosphate dehydrogenase from *Saccharomyces cerevisiae* or its homolog, e.g. as shown herein, for a decrease of the fine chemical, meaning of gamma-Tocopherol/beta-Tocopherol/2,3-Dimethyl-5-phytylquinol in a range as indicated in Table XII, in free or bound form in an organism or a part thereof, as mentioned.

In another embodiment, in the process of the present invention the activity of a YOL059W protein is increased or generated in a subcellular compartment of the organism or organism cell such as in an organelle like a plastid or mitochondria.

The sequence of YOR221 C from *Saccharomyces cerevisiae* has been published in Goffeau et al, Science 274 (5287), 546-547 (1996), and its activity has been defined as a malonyl-CoA:ACP transferase. Accordingly, in one embodiment, the process of the present invention comprises the use of a gene product with an activity of a malonylCoA:ACP transferase from *Saccaromyces cerevisiae* or its homolog, e.g. as shown herein, for a decrease of the fine chemical, meaning of proline in a range as indicated in Table XII, in free or bound form in an organism or a part thereof, as mentioned.

In another embodiment, in the process of the present invention the activity of a YOR221 C protein is increased or generated in a subcellular compartment of the organism or organism cell such as in an organelle like a plastid or mitochondria.

The sequence of YPR011C from *Saccharomyces cerevisiae* has been published in Goffeau et al, Science 274 (5287), 546-547 (1996), and its activity has been defined as a uncharacterized protein. Accordingly, in one embodiment, the process of the present invention comprises the use of a gene product with an activity of said uncharacterized protein from *Saccaromyces cerevisiae* or its homolog, e.g. as shown herein, for a decrease of the fine chemical, meaning of glactolipids in a range as indicated in Table XII, in free or bound form in an organism or a part thereof, as mentioned.

In another embodiment, in the process of the present invention the activity of a YPR011C protein is increased or generated in a subcellular compartment of the organism or organism cell such as in an organelle like a plastid or mitochondria.

The sequence of YPR021C from *Saccharomyces cerevisiae* has been published in Goffeau et al, Science 274 (5287), 546-547 (1996), and its activity has been defined as a mitochondrial transporter. Accordingly, in one embodiment, the process of the present invention comprises the use of a gene product with an activity of a mitochondrial transporter protein from *Saccaromyces cerevisiae* or its homolog, e.g. as shown herein, for a decrease of the fine chemical, meaning of gamma-Tocopherol/beta-Tocopherol/2,3-Dimethyl-5-phytylquinol, shikimic acid and/or tryptophane in a range as indicated in Table XII, in free or bound form in an organism or a part thereof, as mentioned.

In another embodiment, in the process of the present invention the activity of a YPR021C protein is increased or generated in a subcellular compartment of the organism or organism cell such as in an organelle like a plastid or mitochondria.

The sequence of YPR105C from *Saccharomyces cerevisiae* has been published in Goffeau et al, Science 274 (5287), 546-547 (1996), and its activity has been defined as a Golgi-complex-protein. Accordingly, in one embodiment, the process of the present invention comprises the use of a gene product with an activity of a Golgi-complex-protein from *Saccaromyces cerevisiae* or its homolog, e.g. as shown herein, for a decrease of the fine chemical, meaning of gamma-Tocopherol/beta-Tocopherol/2,3-Dimethyl-5-phytylquinol in a range as indicated in Table XII, in free or bound form in an organism or a part thereof, as mentioned.

In another embodiment, in the process of the present invention the activity of a YPR105C protein is increased or generated in a subcellular compartment of the organism or organism cell such as in an organelle like a plastid or mitochondria.

The sequence of YAL038W from *Saccharomyces cerevisiae* has been published in Goffeau et al, Science 274 (5287), 546-547 (1996), and its activity has been defined as a pyruvate kinase. Accordingly, in one embodiment, the process of the present invention comprises the use of a gene product with an activity of a pyruvate kinase protein from *Saccaromyces cerevisiae* or its homolog, e.g. as shown herein, for a decrease of the fine chemical, meaning of glycine and/or serine in a range as indicated in Table XII, in free or bound form in an organism or a part thereof, as mentioned.

In another embodiment, in the process of the present invention the activity of a YAL038W protein is increased or generated in a subcellular compartment of the organism or organism cell such as in an organelle like a plastid or mitochondria.

The sequence of YBL082C from *Saccharomyces cerevisiae* has been published in Goffeau et al, Science 274 (5287), 546-547 (1996), and its activity has been defined as a alpha (1-3) mannosyltransferase. Accordingly, in one embodiment, the process of the present invention comprises the use of a gene product with an activity of a alpha(1-3) mannosyltransferase protein from *Saccaromyces cerevisiae* or its homolog, e.g. as shown herein, for a decrease of the fine chemical, meaning of Glutamate, Glutamine, 5-Oxoproline, Citramalate, Malate, Succinate and/or Shikimic acid in a range as indicated in Table XII, in free or bound form in an organism or a part thereof, as mentioned.

In another embodiment, in the process of the present invention the activity of a YBL082C protein is increased or generated in a subcellular compartment of the organism or organism cell such as in an organelle like a plastid or mitochondria.

The sequence of YBR001C from *Saccharomyces cerevisiae* has been published in Feldmann et al, EMBO J. 13 (24), 5795-5809 (1994), and its activity has been defined as a putative neutral trehalase. Accordingly, in one embodiment, the process of the present invention comprises the use of a gene product with an activity of a putative neutral trehalase protein from *Saccaromyces cerevisiae* or its homolog, e.g. as shown herein, for a decrease of the fine chemical, meaning of fumarate and/or succinate in a range as indicated in Table XII, in free or bound form in an organism or a part thereof, as mentioned.

In another embodiment, in the process of the present invention the activity of a YBR001C protein is increased or generated in a subcellular compartment of the organism or organism cell such as in an organelle like a plastid or mitochondria.

The sequence of YDR035W from *Saccharomyces cerevisiae* has been published in Goffeau et al, Science 274 (5287), 546-547 (1996), and its activity has been defined as a 3-deoxy-D-arabino-heptulosonate-7-phosphate (DAHP) synthase. Accordingly, in one embodiment, the process of the present invention comprises the use of a gene product with an activity of a 3-deoxy-D-arabino-heptulosonate-7-phosphate (DAHP) synthase protein from *Saccaromyces cerevisiae* or its homolog, e.g. as shown herein, for a decrease of the fine chemical, meaning of Glutamine, 5-Oxoproline, Alanine, Aspartate, Glycine, Serine, Fumarate, Glyceric acid, Malate and/or Succinate in a range as indicated in Table XII, in free or bound form in an organism or a part thereof, as mentioned.

In another embodiment, in the process of the present invention the activity of a YDR035W protein is increased or generated in a subcellular compartment of the organism or organism cell such as in an organelle like a plastid or mitochondria.

The sequence of YDR497C from *Saccharomyces cerevisiae* has been published in Goffeau et al, Science 274 (5287), 546-547 (1996), and its activity has been defined as a myo-inositol transporter. Accordingly, in one embodiment, the process of the present invention comprises the use of a gene product with an activity of a myo-inositol transporter protein from *Saccaromyces cerevisiae* or its homolog, e.g. as shown herein, for a decrease of the fine chemical, meaning of shikimic acid in a range as indicated in Table XII, in free or bound form in an organism or a part thereof, as mentioned.

In another embodiment, in the process of the present invention the activity of a YDR497C protein is increased or generated in a subcellular compartment of the organism or organism cell such as in an organelle like a plastid or mitochondria.

The sequence of YEL046C from *Saccharomyces cerevisiae* has been published in Goffeau et al, Science 274 (5287), 546-547 (1996), and its activity has been defined as a threonine aldolase. Accordingly, in one embodiment, the process of the present invention comprises the use of a gene product with an activity of a threonine aldolase protein from *Saccaromyces cerevisiae* or its homolog, e.g. as shown herein, for a decrease of the fine chemical, meaning of threonine and/or UDP-glucose in a range as indicated in Table XII, in free or bound form in an organism or a part thereof, as mentioned.

In another embodiment, in the process of the present invention the activity of a YEL046C protein is increased or generated in a subcellular compartment of the organism or organism cell such as in an organelle like a plastid or mitochondria.

The sequence of YGL126W from *Saccharomyces cerevisiae* has been published in Goffeau et al, Science 274 (5287), 546-547 (1996), and its activity has been defined as a protein involved in the synthesis of inositol phospholipids from inositol. Accordingly, in one embodiment, the process of the present invention comprises the use of a gene product with an activity of a protein involved in the synthesis of inositol phospholipids from inositol from *Saccaromyces cerevisiae* or its homolog, e.g. as shown herein, for a decrease of the fine chemical, meaning of glycine in a range as indicated in Table XII, in free or bound form in an organism or a part thereof, as mentioned.

In another embodiment, in the process of the present invention the activity of a YGL126W protein is increased or generated in a subcellular compartment of the organism or organism cell such as in an organelle like a plastid or mitochondria.

The sequence of YGR289C from *Saccharomyces cerevisiae* has been published in Goffeau et al, Science 274 (5287), 546-547 (1996), and its activity has been defined as a maltose permease. Accordingly, in one embodiment, the process of the present invention comprises the use of a gene product with an activity of a maltose permease protein from *Saccaromyces cerevisiae* or its homolog, e.g. as shown herein, for a decrease of the fine chemical, meaning of fumarate and/or raffinose in a range as indicated in Table XII, in free or bound form in an organism or a part thereof, as mentioned.

In another embodiment, in the process of the present invention the activity of a YGR289C protein is increased or generated in a subcellular compartment of the organism or organism cell such as in an organelle like a plastid or mitochondria.

The sequence of YHR204W from *Saccharomyces cerevisiae* has been published in Goffeau et al, Science 274 (5287), 546-547 (1996), and its activity has been defined as a alpha mannosidase-like protein. Accordingly, in one embodiment, the process of the present invention comprises the use of a gene product with an activity of a alpha mannosidase-like protein from *Saccaromyces cerevisiae* or its homolog, e.g. as shown herein, for a decrease of the fine chemical, meaning of isoleucine, leucine and/or tyrosine in a range as indicated in Table XII, in free or bound form in an organism or a part thereof, as mentioned.

In another embodiment, in the process of the present invention the activity of a YHR204W protein is increased or generated in a subcellular compartment of the organism or organism cell such as in an organelle like a plastid or mitochondria.

The sequence of YJR073C from *Saccaromyces cerevisiae* has been published in Goffeau et al, Science 274 (5287), 546-547 (1996), and its activity has been defined as a phospholipid methyltransferase. Accordingly, in one embodiment, the process of the present invention comprises the use of a gene product with an activity of a phospholipid methyltransferase protein from *Saccaromyces cerevisiae* or its homolog, e.g. as shown herein, for a decrease of the fine chemical, meaning of fumarate in a range as indicated in Table XII, in free or bound form in an organism or a part thereof, as mentioned.

In another embodiment, in the process of the present invention the activity of a YJR073C protein is increased or generated in a subcellular compartment of the organism or organism cell such as in an organelle like a plastid or mitochondria.

The sequence of YKR043C from *Saccharomyces cerevisiae* has been published in Goffeau et al, Science 274 (5287), 546-547 (1996), and its activity has been defined as a uncharacterized protein. Accordingly, in one embodiment, the process of the present invention comprises the use of a gene product with an activity of said uncharacterized protein from *Saccaromyces cerevisiae* or its homolog, e.g. as shown herein, for a decrease of the fine chemical, meaning of glyceric acid in a range as indicated in Table XII, in free or bound form in an organism or a part thereof, as mentioned.

In another embodiment, in the process of the present invention the activity of a YKR043C protein is increased or generated in a subcellular compartment of the organism or organism cell such as in an organelle like a plastid or mitochondria.

The sequence of YLL033W from *Saccharomyces cerevisiae* has been published in Goffeau et al, Science 274 (5287), 546-547 (1996), and its activity has been defined as a putative protein. Accordingly, in one embodiment, the process of the present invention comprises the use of a gene product with an activity of said putative protein from *Saccaromyces cerevisiae* or its homolog, e.g. as shown herein, for a decrease of the fine chemical, meaning of glycerol in a range as indicated in Table XII, in free or bound form in an organism or a part thereof, as mentioned.

In another embodiment, in the process of the present invention the activity of a YLL033W protein is increased or generated in a subcellular compartment of the organism or organism cell such as in an organelle like a plastid or mitochondria.

The sequence of YLR027C from *Saccharomyces cerevisiae* has been published in Goffeau et al, Science 274 (5287), 546-547 (1996), and its activity has been defined as a aspartate aminotransferase. Accordingly, in one embodiment, the process of the present invention comprises the use of a gene product with an activity of a aspartate aminotransferase from *Saccaromyces cerevisiae* or its homolog, e.g. as shown herein, for a decrease of the fine chemical, meaning of alanine, hexadecadienoic aicd and/or UDP-glucose in a range as indicated in Table XII, in free or bound form in an organism or a part thereof, as mentioned.

In another embodiment, in the process of the present invention the activity of a YLR027C protein is increased or generated in a subcellular compartment of the organism or organism cell such as in an organelle like a plastid or mitochondria.

The sequence of YLR099C from *Saccharomyces cerevisiae* has been published in Goffeau et al, Science 274 (5287), 546-547 (1996), and its activity has been defined as a uncharacterized protein. Accordingly, in one embodiment, the process of the present invention comprises the use of a gene product with an activity of said uncharacterized protein from *Saccaromyces cerevisiae* or its homolog, e.g. as shown herein, for a decrease of the fine chemical, meaning of hexadecadienoic aicd in a range as indicated in Table XII, in free or bound form in an organism or a part thereof, as mentioned.

In another embodiment, in the process of the present invention the activity of a YLR099C protein is increased or generated in a subcellular compartment of the organism or organism cell such as in an organelle like a plastid or mitochondria.

The sequence of YNL022C from *Saccaromyces cerevisiae* has been published in Goffeau et al, Science 274 (5287), 546-547 (1996), and its activity has been defined as a uncharacterized protein. Accordingly, in one embodiment, the process of the present invention comprises the use of a gene product with an activity of said uncharacterized protein from *Saccaromyces cerevisiae* or its homolog, e.g. as shown herein, for a decrease of the fine chemical, meaning of proline in a range as indicated in Table XII, in free or bound form in an organism or a part thereof, as mentioned.

In another embodiment, in the process of the present invention the activity of a YNL022C protein is increased or generated in a subcellular compartment of the organism or organism cell such as in an organelle like a plastid or mitochondria.

The sequence of YNL241 C from *Saccaromyces cerevisiae* has been published in Goffeau et al, Science 274 (5287), 546-547 (1996), and its activity has been defined as a glucose-6-phosphate dehydrogenase (G6PD). Accordingly, in one embodiment, the process of the present invention comprises the use of a gene product with an activity of a glucose-6-phosphate dehydrogenase (G6PD) protein from *Saccaromyces cerevisiae* or its homolog, e.g. as shown herein, for a decrease of the fine chemical, meaning of gamma-Tocopherol/beta-Tocopherol/2,3-Dimethyl-5-phytylquinol, glyceric acid and/or succinate in a range as indicated in Table XII, in free or bound form in an organism or a part thereof, as mentioned.

In another embodiment, in the process of the present invention the activity of a YNL241 C protein is increased or generated in a subcellular compartment of the organism or organism cell such as in an organelle like a plastid or mitochondria.

The sequence of YNR012W from *Saccaromyces cerevisiae* has been published in Goffeau et al, Science 274 (5287), 546-547 (1996), and its activity has been defined as a Uridine/cytidine kinase. Accordingly, in one embodiment, the process of the present invention comprises the use of a gene product with an activity of a Uridine/cytidine kinase protein from *Saccaromyces cerevisiae* or its homolog, e.g. as shown herein, for a decrease of the fine chemical, meaning of gamma-Tocopherol/beta-Tocopherol/2,3-Dimethyl-5-phytylquinol, glycine and/or cerotic acid in a range as indicated in Table XII, in free or bound form in an organism or a part thereof, as mentioned.

In another embodiment, in the process of the present invention the activity of a YNR012W protein is increased or generated in a subcellular compartment of the organism or organism cell such as in an organelle like a plastid or mitochondria.

The sequence of YPL080C from *Saccaromyces cerevisiae* has been published in Marsischky et al, submitted (17 Feb. 2004) Biological Chemistry and Molecular Pharmacology, Harvard Institute of Proteomics, 320 Charles St., Cambridge, Mass. 02141, USA, and its activity has been defined as a Uridine/cytidine kinase. Accordingly, in one embodiment, the process of the present invention comprises the use of a gene product with an activity of a Uridine/cytidine kinase protein from *Saccaromyces cerevisiae* or its homolog, e.g. as shown herein, for a decrease of the fine chemical, meaning of homoserine in a range as indicated in Table XII, in free or bound form in an organism or a part thereof, as mentioned.

In another embodiment, in the process of the present invention the activity of a YPL080C protein is increased or generated in a subcellular compartment of the organism or organism cell such as in an organelle like a plastid or mitochondria.

The sequence of YPR035W from *Saccaromyces cerevisiae* has been published in Goffeau et al, Science 274 (5287), 546-547 (1996), and its activity has been defined as a glutamine synthase. Accordingly, in one embodiment, the process of the present invention comprises the use of a gene product with an activity of a glutamine synthase protein from *Saccaromyces cerevisiae* or its homolog, e.g. as shown herein, for a decrease of the fine chemical, meaning of Linolenic acid (C18:cis[9,12,15]3), Glycine, Phenylalanine, Fumarate and/or Lignoceric acid (C24:0) in a range as indicated in Table XII, in free or bound form in an organism or a part thereof, as mentioned.

In another embodiment, in the process of the present invention the activity of a YPR035W protein is increased or generated in a subcellular compartment of the organism or organism cell such as in an organelle like a plastid or mitochondria.

for the disclosure of the paragraphs [0400.0.0.25] to [0435.0.0.25] see paragraphs [0400.0.0.0] to [0435.0.0.0] above.

Isoleucine production in *Chlamydomonas reinhardtii*

The amino acid production can be analysed as mentioned above. The proteins and nucleic acids can be analysed as mentioned below.

for the disclosure of the paragraphs [0437.0.0.25] to [0497.0.0.25] see paragraphs [0437.0.0.0] to [0497.0.0.0] above.

The Results of the Different Plant Analyses can be Seen from the Table XII and XIII for the disclosure of the paragraphs [0499.0.0.25] and [0500.0.0.25] see paragraphs [0499.0.0.0] and [0500.0.0.0] above.

Example 15a

Engineering Ryegrass Plants by Over-Expressing b001 from *Escherichia coli* or Homologs of b001 from Other Organisms for the disclosure of the paragraphs [0502.0.0.25] to [0508.0.0.25] see paragraphs [0502.0.0.0] to [0508.0.0.0] above.

Example 15b

Engineering Soybean Plants by Over-Expressing B001 from *Escherichia coli* or Homologs of b001 from Other Organisms for the disclosure of the paragraphs [0510.0.0.25] to [0513.0.0.25] see paragraphs [0510.0.0.0] to [0513.0.0.0] above.

Example 15c

Engineering Corn Plants by Over-Expressing B001 from *Escherichia coli* or Homologs of b001 from Other Organisms for the disclosure of the paragraphs [0515.0.0.25] to [0540.0.0.25] see paragraphs [0515.0.0.0] to [0540.0.0.0] above.

Example 15d

Engineering Wheat Plants by Over-Expressing B001 from *Escherichia coli* or Homologs of B001 from Other Organisms for the disclosure of the paragraphs [0542.0.0.1] to [0544.0.0.1] see paragraphs [0542.0.0.0] to [0544.0.0.0] above.

0545.0.25.25

Example 15e

Engineering Rapeseed/Canola Plants by Over-Expressing B001 from *Escherichia coli* or Homologs of B001 from Other Organisms for the disclosure of the paragraphs [0546.0.0.25] to [0549.0.0.25] see paragraphs [0544.0.0.0] to [0549.0.0.0] above.

Example 15f

Engineering Alfalfa Plants by Over-Expressing B001 from *Escherichia coli* or Homologs of B001 from Other Organisms for the disclosure of the paragraphs [0551.0.0.25] to [0554.0.0.25] see paragraphs [0551.0.0.0] to [0554.0.0.0] above.
%
for the disclosure of this paragraph see [0554.2.0.0] above.
for the disclosure of this paragraph see [0555.0.0.0] above.

Lengthy table referenced here

US08952217-20150210-T00001

Please refer to the end of the specification for access instructions.

Lengthy table referenced here

US08952217-20150210-T00002

Please refer to the end of the specification for access instructions.

Lengthy table referenced here

US08952217-20150210-T00003

Please refer to the end of the specification for access instructions.

Lengthy table referenced here

US08952217-20150210-T00004

Please refer to the end of the specification for access instructions.

Lengthy table referenced here

US08952217-20150210-T00005

Please refer to the end of the specification for access instructions.

Lengthy table referenced here

US08952217-20150210-T00006

Please refer to the end of the specification for access instructions.

Lengthy table referenced here

US08952217-20150210-T00007

Please refer to the end of the specification for access instructions.

Lengthy table referenced here

US08952217-20150210-T00008

Please refer to the end of the specification for access instructions.

Lengthy table referenced here

US08952217-20150210-T00009

Please refer to the end of the specification for access instructions.

Lengthy table referenced here

US08952217-20150210-T00010

Please refer to the end of the specification for access instructions.

Lengthy table referenced here

US08952217-20150210-T00011

Please refer to the end of the specification for access instructions.

Lengthy table referenced here

US08952217-20150210-T00012

Please refer to the end of the specification for access instructions.

Lengthy table referenced here

US08952217-20150210-T00013

Please refer to the end of the specification for access instructions.

Lengthy table referenced here

US08952217-20150210-T00014

Please refer to the end of the specification for access instructions.

Lengthy table referenced here

US08952217-20150210-T00015

Please refer to the end of the specification for access instructions.

Lengthy table referenced here

US08952217-20150210-T00016

Please refer to the end of the specification for access instructions.

Lengthy table referenced here

US08952217-20150210-T00017

Please refer to the end of the specification for access instructions.

Lengthy table referenced here

US08952217-20150210-T00018

Please refer to the end of the specification for access instructions.

Lengthy table referenced here

US08952217-20150210-T00019

Please refer to the end of the specification for access instructions.

Lengthy table referenced here

US08952217-20150210-T00020

Please refer to the end of the specification for access instructions.

Lengthy table referenced here

US08952217-20150210-T00021

Please refer to the end of the specification for access instructions.

Lengthy table referenced here

US08952217-20150210-T00022

Please refer to the end of the specification for access instructions.

Lengthy table referenced here

US08952217-20150210-T00023

Please refer to the end of the specification for access instructions.

Lengthy table referenced here

US08952217-20150210-T00024

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US08952217B2). An electronic copy of the table will also be available from the USPTO upon request and payment of the fee set forth in 37 CFR 1.19(b)(3).

SEQUENCE LISTING (73449 sequences)

SEQ ID NO: 1 - DNA, 1440 bp, Saccharomyces cerevisiae
  CDS (1)..(1440)
atgttcttttcaaaagttatgcttactcggcgtattttggtgaggggtttggcaacagccaaatcttcagctccaaagttaacagatgtattaatcgtaggtgggggtcctgcaggtttgactttagctgcatcgattaagaattctccgcaattaaaagatctaaagacaactttagtcgatatggtggacttaaaagataaattatcggacttttataattcacccccagattattttacgaacaggattgtcagtgttacgcctagatctattcattttcttgagaataacgctggggcaactttgatgcatgacaggattcaaagttatgacggactctatgtcacggacggttgttctaaggctactttggatctggcaagggactccatgctttgtatgattgaaattataaatatacaggcctccttatacaacagaatttctcagtacgattcaaagaaggactccattgatattattgataatacaaaagttgtcaatattaaacacagcgaccctaatgatccattgtcctggcctttagtcactctttccaatggtgaagtatacaagacgagattgctagtgggtgcagacgggttcaattctcctaccagaagattttcccagatcccatctaggggctggatgtataatgcctatggtgttgtggccagcatgaagttagagtatcctccctttaaactaaggggctggcagaggttcttacccactggtccaattgcacacttacccatgcctgaaaataatgctactttagtctggagttcatctgaacgtttatcgaggcttttgttgtcattacctccagaatcattcactgcacttatcaatgctgcttttgtcttggaagacgcagacatgaactactattaccgtacattggaagatggctctatggacaccgataaattgatagaagatattaaattcagaactgaggaaatatacgccacgttgaaggacgagtcggatattgatgaaatttacccaccaagagttgttagtataatagataagacaagagcacgttttcccttaaaattaacacatgcagatcgttattgcactgatagagttgcccttgttggggacgcagcacatacgacacatcctctcgctggacaggggttaaacatggggcaaacagacgttcatggtttagtatacgctttagaaaaggcaatggaaagaggtttagacattggctcttcattgagcttagaacccttttgggcagaaagatatccgtcgaacaacgttctattaggaatggcggataaattatttaaattatatcacactaattttcctcctgtggtagccctaagaacttttggtttgaatctgacgaataagatcggtccagttaagaatatgatcattgacacattaggaggaaatgagaaatga

SEQ ID NO: 2 - protein, 479 aa, Saccharomyces cerevisiae
MFFSKVMLTRRILVRGLATAKSSAPKLTDVLIVGGGPAGLTLAASIKNSPQLKDLKTTLVDMVDLKDKLSDFYNSPPDYFTNRIVSVTPRSIHFLENNAGATLMHDRIQSYDGLYVTDGCSKATLDLARDSMLCMIEIINIQASLYNRISQYDSKKDSIDIIDNTKVVNIKHSDPNDPLSWPLVTLSNGEVYKTRLLVGADGFNSPTRRFSQIPSRGWMYNAYGVVASMKLEYPPFKLRGWQRFLPTGPIAHLPMPENNATLVWSSSERLSRLLLSLPPESFTALINAAFVLEDADMNYYYRTLEDGSMDTDKLIEDIKFRTEEIYATLKDESDIDEIYPPRVVSIIDKTRARFPLKLTHADRYCTDRVALVGDAAHTTHPLAGQGLNMGQTDVHGLVYALEKAMERGLDIGSSLSLEPFWAERYPSNNVLLGMADKLFKLYHTNFPPVVALRTFGLNLTNKIGPVKNMIIDTLGGNEK

SEQ ID NO: 3 - DNA, 1260 bp, Nostoc sp. PCC 7120
  CDS (1)..(1260)
atggcgctaacgcagcttactcaaactatttctcctcaaccgacaccgccagaactgcgaaaatacgactatgatttagtcatcgtcggcggtggaattgttgggttaactctagcttcagcattaaaagattctggcttgaatatactgctaattgaagccaaagttgcatcagcagcagtagctaaaggtcaagcctacgcagttcatctactatcagccctaatttaccaaggaattggtatttgggataaaattctgcctcagattgccaagtaccgccaagtccgtctttctgatgctgattatcctggtgtggtggagtttgaaagcacagatttagggacaccagaattaggttatgtagcggaacatcaagcgttactggaacctctacaggagtttgtgcagaattgcccaaatgtgacttatctttgtccggctgaggtggtgagtaccaattaccagccaaatgaagtagtcatcgctgttaaaattgccgatcaattaaacacaattcgtagcaaattactggtagccgcagatggatcgcgatcgcctattcgtcaggcggcggggattaaaactcatggctggaagtattggcaatcttgcattgtggctttcgttaagccagagaaaccccataacgatacagcttacgaaagattttggcctagtggcccctttgcgattttacctctacctgagaaccgttgccgcatcgtttggacggctccccacgatgaagcaaaagccctttgtgccttaaatgacgaagaatttttacgagaacttagccaacgctttgggcagcaaatgggtaagttggaattattaggcgatcgcttcgtttttcaagtacaactaatgcaaagcgatcgttatgtccttccccgtttagctttagttggcgatgcggcacataattgtcatcctgtgggtggacaaggattaaacttgggtattcgagatgtcgccgctttagcccaagtcattcaaaaagcacatcaagctggtgaagatattggtaatattcgggtcttgaaacgttacgaaagctggcgacaaaaagagaacctagccattttagggttcactgatatgttagaccggatgttctctaaccaattccctccgttggtgtttcttcgtcgcttgggtttatggtttttacgcagtgtccctgtgctgaaaacatttatgctcaagttgatgattgggttgaagggaaaaactccagaattggctaaacgttga

SEQ ID NO: 4 - protein, 419 aa, Nostoc sp. PCC 7120
MALTQLTQTISPQPTPPELRKYDYDLVIVGGGIVGLTLASALKDSGLNILLIEAKVASAAVAKGQAYAVHLLSALIYQGIGIWDKILPQIAKYRQVRLSDADYPGVVEFESTDLGTPELGYVAEHQALLEPLQEFVQNCPNVTYLCPAEVVSTNYQPNEVVIAVKIADQLNTIRSKLLVAADGSRSPIRQAAGIKTHGWKYWQSCIVAFVKPEKPHNDTAYERFWPSGPFAILPLPENRCRIVWTAPHDEAKALCALNDEEFLRELSQRFGQQMGKLELLGDRFVFQVQLMQSDRYVLPRLALVGDAAHNCHPVGGQGLNLGIRDVAALAQVIQKAHQAGEDIGNIRVLKRYESWRQKENLAILGFTDMLDRMFSNQFPPLVFLRRLGLWFLRSVPVLKTFMLKLMIGLKGKTPELAKR

SEQ ID NO: 5 - DNA, 1359 bp, Brucella melitensis
  CDS (1)..(1359)
atgatcgcaatttggtttaagtgcggcggaaacgcatctggcaagaatcgcttttgctgccagtatcaagagcggcggcttcacccgaaaccgccatggccgaggatgagcgcgatgaatgacgtggttgtaaacaagcccctcaccgacattgttatcagtggcggcggcccggccggcatgatggcggcgctggcgcttggggtccgcggctaccataccgtgctgctcggccccgaaaccgacaagaccgaccggcgcaccaccgcactgatgatgcccgcgatccgttttctggagcagatcggcgtctgggctgcgatcgagccggaagcggctcccttgcaatccatgcgcatcgtggatgcaaccaggcgccttatccgcagccctgcggtcatgttccgtgcgagcgagattgatgagattgccttcggctacaacatccccaacgccgtgctgaatgcaaagcttgccgaagcggtcgcggccagtcgcaatatccggcgcatcactgtcccggccatcgaatatcgccccaatggcgaccatgtcaccgtgacgctcaaggggggcgatacgctgcacacacgcctgttggtcgccgccgacgggcgcaattccggtgcgcgcgacgccgctggcatccgcacccgccgctggagctatccgcaaacggccgtggttctttccttttcccatatgattgaccacgagaatatttcgaccgaatttcacaccgaagaaggcccgtttacacaagtgccgctcaaggggcggcgatcaagcctcgtctgggtggttaatccggcgcgcgccgaaaagctgctttcaatgagcgatgaggctcttgcggtccatatcgaggagatgatgcaatccatgctgggcaagatcacgctggaggtgcgcccgcaagcctggccgctttccggcctcgtgccccatgtctttgcagcaaagcgcaccatcctgatcggcgaagctgcccatgtctttccgcccatcggcgcgcaagggctgaaccttggcacacgcgacgtggaaacactggtaaaggccattgagagcgattcggtcgatcccggttccgagcgtgtcatgcgcgcttatgaccgcgcgcggcgtcccgatattttcgcgcgtaccggctcggtcgatgcgctcaaccgctcgctgctttcctccatgctgcctgcgcagatcctgcgcggtgtagggctggaaatgcttcgctcctttgcgccgctgcgcgcgttcttcatgcgcgagggccttcgccccggcagcggtttttcgcaccttctgccccggctcccgcgtctgcccggcaaagctgacgacgccgcaagacaatag

SEQ ID NO: 6 - protein, 452 aa, Brucella melitensis
MIAIWFKCGGNASGKNRFCCQYQERRLHPKPPWPRMSAMNDVVVNKPLTDIVISGGGPAGMMAALALGVRGYHTVLLGPETDKTDRRTTALMMPAIRFLEQIGVWAAIEPEAAPLQSMRIVDATRRLIRSPAVMFRASEIDEIAFGYNIPNAVLNAKLAEAVAASRNIRRITVPAIEYRPNGDHVTVTLKGGDTLHTRLLVAADGRNSGARDAAGIRTRRWSYPQTAVVLSFSHMIDHENISTEFHTEEGPFTQVPLKGRRSSLVWVVNPARAEKLLSMSDEALAVHIEEMMQSMLGKITLEVRPQAWPLSGLVPHVFAAKRTILIGEAAHVFPPIGAQGLNLGTRDVETLVKAIESDSVDPGSERVMRAYDRARRPDIFARTGSVDALNRSLLSSMLPAQILRGVGLEMLRSFAPLRAFFMREGLRPGSGFSHLLPRLPRLPGKADDAARQ

SEQ ID NO: 7 - DNA, 1179 bp, Yersinia pestis
  CDS (1)..(1179)
atgagtgtgataattgttggtggtggaatggcgggggtaactctggcactggccatttcatcccttactcacgggcaggtgcccgttgcactggttgaggcgcaacaacccaatgaccggcaacatccgggctttgatgccagagcgattgcgctggcgcaggggacttgccagcagttggcgcgcattggtgcctggtcggcattggccgattgtgccacggccattgatcatgttcatgtcagtgatcgcggtcattctggttttgttaatttgcgggctgaagattacggtgtaccggcgctggggcatgttctcgagctacatgatgctggtgaacggctctttgccttgctgatgaaagcaccgggggtgacgctgcattgtccggccaaagtggttgatgtggttcgtaccgctgaatccgcccgtgtgacgctggatgacgggcaacaactggcggcaaaattgctggtggccgcagacggttctcactcggcattagcccaatcctgcgctatccaatggcagcgacaggattaccaacaggttgcaattattgcgaatatcaccacctccgagctaccgaatggccgtgcttttgagcgttttacccgcaatgggccattagctttactgccgatgtctcaggggcgcagttctttggtttggtgccatgcgaagcatgatcaacaacagatcgatagctgggatgacgcgcgttttttggcagagctacagcaagcctttggttggcggttggggaaaatgcttcaggcgggtaaacgccacagctacccattacagttactgattgcgtcacgtcatatcagccaccgcctggcgttggtggggaatgcggcacaaaccttacatccgatagccggtcaggggtttaatcttggcctgcgggatgtgatgtcactggctgaaacccttgcagaggctgcggccatggggaatgatctcggtgactataccgttcttagccactatcagcagcggcgtcagcaggatcaacaggcgactattggcgttactgatggtttgatccgtttgtttgcgaatcgctatgggccgttagtcgcagggcggaatttggcgctgatggccatggaacagatgcccacaatacgtgatacttttgctcggcgtacattgggctgggtcgagcgctaa

SEQ ID NO: 8 - protein, 392 aa, Yersinia pestis
MSVIIVGGGMAGVTLALAISSLTHGQVPVALVEAQQPNDRQHPGFDARAIALAQGTCQQLARIGAWSALADCATAIDHVHVSDRGHSGFVNLRAEDYGVPALGHVLELHDAGERLFALLMKAPGVTLHCPAKVVDVVRTAESARVTLDDGQQLAAKLLVAADGSHSALAQSCAIQWQRQDYQQVAIIANITTSELPNGRAFERFTRNGPLALLPMSQGRSSLVWCHAKHDQQQIDSWDDARFLAELQQAFGWRLGKMLQAGKRHSYPLQLLIASRHISHRLALVGNAAQTLHPIAGQGFNLGLRDVMSLAETLAEAAAMGNDLGDYTVLSHYQQRRQQDQQATIGVTDGLIRLFANRYGPLVAGRNLALMAMEQMPTIRDTFARRTLGWVER

SEQ ID NO: 9 - DNA, 1203 bp, Salmonella enterica subsp. enterica serovar Typhi
  CDS (1)..(1203)
atgcaaagtgttgatgtagcaatagttggcggaggcatggtgggactggctgtcgcctgcggcttgcaggggagcggtttgcgcgttgcggtactggatcacgttgttccccagcagttggcgaacgatgcgccgcctcagcttcgggtgtcggcgattaatgccgccagcgaaaaactgcttacccgtcttggcgtatggtcaaacattgtggcgcgacgggcaagttgctaccacggtatggaagtctgggataaagacagctttggccgtattacgtttgatgacgcaagcatgggatatagccatctggggcatattgttgaaaacagcgtcattcactatgcactgtggcaaaaagcgcagcaagcggcggatatcaccttaatggcgccagcggagttacagcaggttgcctggggagagaatgacgccttcctgactttaaaagacggcgcgatgttaaccgcgcgtctggtgattgccgcggatggcgccaactcctggctgcgtaacaaagcggatattcccttaactttctgggactaccgtcaccatgcgctggtagcgactatccgcaccgaagagccgcacggcgcggttgctcgccaggtgtttcatggtgaaggtattctggcgtttttgccgttaagcgatccgcatctgtgttccattgtctggtcgctttctccgcaggatgcggagcgtatgcaacagagcggcgacgaggcgtttaaccaggcgttgactatcgccttcgataatcggctgggcttatgccgcctggaaagcgaacggcaggtttttccgctgacgggccgctatgctcgccagtttgccgcgcatcgtctggcgttggtcggcgatgccgcgcacaccatccatccgctggcagggcaaggcgtcaacctcggttttatggacgcggccgaactggtggacgatctgtgccggcttcagcgccagggcaaagacattggccaacatctttatctccgtcgttatgagcgtagccgtaaacatagcgcggcgatgatgcttgccgggatgcaaggttttcgtgacctgtttgccggcgaaaacccggcaaaaaaattgctgcgcgacatcggactgaaactggcggacacgctccccggcgtcaaaccccaactgcttcgccaggcaatggggctaaacgaccttccgcaatggcttcgttaa

SEQ ID NO: 10 - protein, 400 aa, Salmonella enterica subsp. enterica serovar Typhi
MQSVDVAIVGGGMVGLAVACGLQGSGLRVAVLDHVVPQQLANDAPPQLRVSAINAASEKLLTRLGVWSNIVARRASCYHGMEVWDKDSFGRITFDDASMGYSHLGHIVENSVIHYALWQKAQQAADITLMAPAELQQVAWGENDAFLTLKDGAMLTARLVIAADGANSWLRNKADIPLTFWDYRHHALVATIRTEEPHGAVARQVFHGEGILAFLPLSDPHLCSIVWSLSPQDAERMQQSGDEAFNQALTIAFDNRLGLCRLESERQVFPLTGRYARQFAAHRLALVGDAAHTIHPLAGQGVNLGFMDAAELVDDLCRLQRQGKDIGQHLYLRRYERSRKHSAAMMLAGMQGFRDLFAGENPAKKLLRDIGLKLADTLPGVKPQLLRQAMGLNDLPQWLR

SEQ ID NO: 11 - DNA, 1179 bp, Salmonella enterica subsp. enterica serovar Typhi
  CDS (1)..(1179)
atgagcgtcattatcgttggcggcggcatggcaggcgcaacgctggcgctggccatctctcagttcagtcatgggacgttgccggtacacctgattgaagcgaaagcgcctgaagccgacggtcatcccggctttgacgccagagcgattgcgctggcggcgggcacttgccagcaactggcgcgaattggcgtctggcaggcgatttccgattgcgcaacggcaatcaacaccgtacacgtcagcgatcgcggtcatgccggatttgtgactctagacgcgcaggattacagcctggcagcgttgggtcacgttgcggagctgcatgatatcgggctgcgtctgtttgcgctcttgcgtaaagcgccaggcgttacgctgcactgcccggagcgcgtagccagcgtgtcgcgtacccaacagcaggttaacgtcactctggaaaacggcaatgtgatagctggcagcgtgctggtggcggctaacggtacccactccgcgctggcatcagcctgcggcgttgactggcatcaggagccttacgaacagttagcggtgatagcgaatgtcgcgaccgctatcccgcaccagggacgcgcctttgaacgttttacccccaatggcccgctggcgatgttgccgatgtcgcatggccgatgttcgctggtttggtgtcacccgctcgaccagcgcgatgaggtgctgagctggtccgacgcgcagttctgtcatgcgttgcaggccgcgttcggctggcggctggggcgaattactcaggcgggtaagcgcagcgcgtatccgcttgccctgactacggcggcgaaagtgtttactcaccggactgtcgtggtcggcaatgcggcgcagacgttgcatcctatcgccggacaagggtttaatctcggtctgcgcgatgtcatgagcctggcggaaacgctggtcgcggcacaggacgcgggcgaggatattggcgcctggcacgtgttatcgcgctatcagcagcgtcgtcaggttgaccgggatacgacgattggcgtaacgaacggtctggtccatctgtttgcaaatcgttgggcgccgctggttattgggcgcaatatcggtttaatggcgatggaattattaccacctgcgcgcgatgcgctggcacagcgaaccttaggttgggttgcgcgttaa

SEQ ID NO: 12 - protein, 392 aa, Salmonella enterica subsp. enterica serovar Typhi
MSVIIVGGGMAGATLALAISQFSHGTLPVHLIEAKAPEADGHPGFDARAIALAAGTCQQLARIGVWQAISDCATAINTVHVSDRGHAGFVTLDAQDYSLAALGHVAELHDIGLRLFALLRKAPGVTLHCPERVASVSRTQQQVNVTLENGNVIAGSVLVAANGTHSALASACGVDWHQEPYEQLAVIANVATAIPHQGRAFERFTPNGPLAMLPMSHGRCSLVWCHPLDQRDEVLSWSDAQFCHALQAAFGWRLGRITQAGKRSAYPLALTTAAKVFTHRTVVVGNAAQTLHPIAGQGFNLGLRDVMSLAETLVAAQDAGEDIGAWHVLSRYQQRRQVDRDTTIGVTNGLVHLFANRWAPLVIGRNIGLMAMELLPPARDALAQRTLGWVAR

SEQ ID NO: 13 - DNA, 1203 bp, Escherichia coli
  CDS (1)..(1203)
atgcaaagtgttgatgtagccattgttggcggcggcatggtggggctggcggttgcctgtggcttacaggggagcggcttacgcgttgccgtactggagcagcgcgtacaggaacctctggcggcgaatgcaccaccacaactgcgcgtttcggctatcaatgccgccagcgaaaaattactcacccgtcttggcgtctggcaggacattctctctcgtagggccagctgttatcacggtatggaagtgtgggacaaagacagctttggtcacatttcgtttgacgatcaaagcatgggctatagccatcttgggcatatcgttgaaaattcagtgattcactacgcgctgtggaacaaagcgcatcagtcgtcagatatcactctgttagcccccgcagaattacagcaggtcgcctggggagaaaatgaaaccttcctgacgctgaaagatggcagcatgttaacggcgcgtctggtgattggcgcggacggcgctaattcctggttgcgcaacaaagccgatattccgctgactttctgggattatcagcatcacgcgctggtagcgaccattcgcacggaagaaccgcatgatgcggtggcgcggcaggttttccatggcgaaggcattctggcctttttaccgcttagcgatccgcatctttgctcgattgtctggtcactgtcgccagaggaagcgcagcggatgcagcaggcaagtgaagacgaatttaatcgcgcgttaaatatcgcttttgataatcgcctgggcttatgcaaggttgagagcgcgcgtcaggtgttcccactgacggggcgttatgcgcgccagtttgcctcgcaccgtctggcgctggtgggcgacgccgcacataccattcacccgctggcggggcagggggtaaatctcggctttatggatgctgcagagctgattgccgaactgaaacggttgcatcgtcaggggaaagacatcgggcagtacatttatctgcgtcgctatgagcgtagccgcaagcacagtgcggcgttgatgctggctggtatgcagggattccgcgatctgttttccggtaccaatccggcgaaaaaactgctgcgtgatattggtttgaaactggccgacacgcttcctggcgttaagccgcaacttatccgccaggcaatgggattaaacgatttgcctgaatggctgcgttaa

SEQ ID NO: 14 - protein, 400 aa, Escherichia coli [sequence omitted]

SEQ ID NO: 15 - DNA, 1230 bp, Caulobacter crescentus
  CDS (1)..(1230)
atgatcatcgccggcgccggcatggccggctccaccctggccctggctctggcctcgggcggcctgaggccgctgctggtcgatcctgcgcccttcgaggcccagctggccccgaccttcgatggtcgcagctcggcgatcgcctattcctcgttccgtcagtggcgggcgatcggcgcgggccaggcgctggagccgcacgcccagcgcatcgagcagatcctggtcaccgacggccgcacgcccggcgcggcggcccgcaagccgctgccggccttcctgcgcttcgactccagtgagatctccgggcgcatcgagggcgagccgctgggctatctggtcgagaaccgccagatccgcgccgcgctctccaaggccgtcatcgacaagaacatcccggtgattgcgccgatggccgccaaggccttgtcggtcgagcccggcgcggcaaagctgaccctgtcggacggccgagtgctgaccgcgcctctggccgtcagcgccgaggggcggggctcggtgctacgccgcgcagccggtatcggcgacatcggctggagctatggccagagcggcgtggtctgcaccgtcaggctggagcgcccgcacgagggcgtggcccacgaatacttcctgcccagcggccccttcgccatcctgccgctgaccgacaatcgcgcgagcctcgtgtggaccgagagcaccgcgcgcggcgaggccttgcgccaggcgggccccgaggccttccacgcccacctgatgcgccggttcggcgacttcctgggcgcggtgtcgatcgaggggccgatcttcgtctatccgctgtcgctgtccctggccgagcgcatggtcgccccgcgtctggccttgattggtgacgccgctcacggcgtgcacccgatcgcgggtcagggcctgaatctgggcctcaaggacgccgccgccctggccgaagtgctggtcgaggcggtgcgccacggcgaagacatcggggccgaggccgtgctggagcgttacgcccgctggcggcggttcgacaccgtgaccaacgccctggccttcgacgcctttgtgcggatcttctccaacgacaacccgctgctgcggctggcgcggggcgcgggtctggcggtggtcaaccagatcgccccggcgcgccgcttcttcatgcacgaggccggcggcggggtgggtgatctgccgaagcttttgcgggggcaagcgctgtaa

SEQ ID NO: 16 - protein, 409 aa, Caulobacter crescentus
MIIAGAGMAGSTLALALASGGLRPLLVDPAPFEAQLAPTFDGRSSAIAYSSFRQWRAIGAGQALEPHAQRIEQILVTDGRTPGAAARKPLPAFLRFDSSEISGRIEGEPLGYLVENRQIRAALSKAVIDKNIPVIAPMAAKALSVEPGAAKLTLSDGRVLTAPLAVSAEGRGSVLRRAAGIGDIGWSYGQSGVVCTVRLERPHEGVAHEYFLPSGPFAILPLTDNRASLVWTESTARGEALRQAGPEAFHAHLMRRFGDFLGAVSIEGPIFVYPLSLSLAERMVAPRLALIGDAAHGVHPIAGQGLNLGLKDAAALAEVLVEAVRHGEDIGAEAVLERYARWRRFDTVTNALAFDAFVRIFSNDNPLLRLARGAGLAVVNQIAPARRFFMHEAGGGVGDLPKLLRGQAL

SEQ ID NO: 17 - DNA, 1179 bp, Escherichia coli
  CDS (1)..(1179)
atgagcgtaatcatcgtcggtggcggcatggcgggcgcgacgctggcgctggctatttcccggttaagtcacggggcgctgccggtacatttgattgaagcgactgcgccagagtcacatgctcatccgggctttgatggacgagcgatagcgctggcggcgggtacctgtcagcaactggcgcgcatcggcgtctggcaatctctggcggattgcgcaactgccatcaccaccgtgcatgtcagcgatcgtggtcacgctggatttgtcaccctcgccgcagaagattaccaactggcggcgctgggacaggttgtcgaattgcacaatgtcgggcaacggctgtttgcattgctgcgtaaagcacctggcgtaacgctgcattgccctgatcgcgtggctaacgttgcccgtactcagagtcacgttgaagtgacgctggagagtggcgagacgctgacgggccgcgtgctggtagcagctgatggcacccattcagcgttagccaccgcgtgcggcgttgactggcagcaggagccttacgaacaactggccgtgattgccaacgttgctacttccgttgcgcatgaagggcgcgcttttgaacgctttacgcaacatggcccgctggcgatgttgccgatgtctgacggacgctgttcgctggtctggtgtcatccactggaacggcgcgaagaggtgttgtcgtggagtgacgagaagttttgccgtgaactccagtcggcctttggctggcgacttgggaaaattacccacgctggtaaacgcagtgcttatccgctggcgttaacccacgccgccagatctattacccatcgtaccgtgctggtgggcaatgcggcgcaaactctgcacccgattgccgggcaagggtttaacctcggtatgcgagatgtgatgagtcttgcggaaaccctgactcaggcgcaggagcgcggagaagacatgggggattacggcgtattgtgccgttatcagcagcgtcgacagagcgatcgcgaagcaaccattggcgtcacggacagccttgtacatctttttgccaaccgttgggcaccgctggttgtcgggcgcaacatcgggctgatgacgatggaattattcaccccggcacgcgatgtgctggcgcagcgcaccctcggttgggtggcgcgttga

SEQ ID NO: 18 - protein, 392 aa, Escherichia coli [sequence omitted]

SEQ ID NO: 19 - DNA, 1230 bp, Vibrio cholerae
  CDS (1)..(1230)
atgatgcaaagcgttgatgttgtaattatcggtggcggtatggtcggcctagcgttagcggcggctctgaaagagagtgacctacgcattgctgtggttgagaaccaattaccggaagaggcgctaaacccgctgccggatgtgcgcgtttctgccttgagtcgctcaagtgagattgtgctgcgtaatcttaatgcttgggcgggcattgaagcgcgccgcgctgcgccctacatcgcgatggaagtgtgggagcaagatagttttgcgcggattgaatttaaagccaatgagatgacgcagcctaatctgggacacattgttgaaaaccgagtcattcagttggcgctgttcgagcaagttcagcagcaagccaatgtgacactgcatgtgcctgcgacctgtcagagcatcgccgtgggtgaaagcgaagcatggctaaccttgagtaatggccaagccttgagcgcaaaattggtcgtaggggccgatggcgcaaactcttggttgcgtcgacaaatggatattcctttgactcattgggattatggacacagtgctttggtggccaatgtgcgtaccagtgatccgcacaataaagtcgcgcgccagatttttactgcccaaggaccgttagcctttctccccatgtctgagccgcatatgagttcgattgtgtggtcgacagagccttcacgcgctgaagctttgctcaatatgaatgatgtgcagtttaacaaagcgctgaccgcagaattcgatgcacgattaggccgctgtgaagtagtgggcgagcggcaggctttcccacttaagatgcgttatgcccgtgattttgttgcgcctcgggttgctctcgtcggggatgccgcgcacaccattcatccgctggctgggcagggagtgaacttaggtttactggatgctgcctgtttggcacaagagctgctgagcttatggcagcaaaatcgcgacattggtgatgagcgtaatttgcgccattatgagcgctggcggaaagcggaagctgccaaaatgattgcggcgatgcaaggtttccgcgatctgtttgagggggataaccctgctaagaaactgatccgtgggatcggcatgcgtctggttggtcaattgccgggtgccaaagatgaaatcatgaaacgcgcactaggcctgaagggcgatctgcctgagctggcgaagcaggtttggttagagcgtgcctactga

SEQ ID NO: 20 - protein, 409 aa, Vibrio cholerae
MMQSVDVVIIGGGMVGLALAAALKESDLRIAVVENQLPEEALNPLPDVRVSALSRSSEIVLRNLNAWAGIEARRAAPYIAMEVWEQDSFARIEFKANEMTQPNLGHIVENRVIQLALFEQVQQQANVTLHVPATCQSIAVGESEAWLTLSNGQALSAKLVVGADGANSWLRRQMDIPLTHWDYGHSALVANVRTSDPHNKVARQIFTAQGPLAFLPMSEPHMSSIVWSTEPSRAEALLNMNDVQFNKALTAEFDARLGRCEVVGERQAFPLKMRYARDFVAPRVALVGDAAHTIHPLAGQGVNLGLLDAACLAQELLSLWQQNRDIGDERNLRHYERWRKAEAAKMIAAMQGFRDLFEGDNPAKKLIRGIGMRLVGQLPGAKDEIMKRALGLKGDLPELAKQVWLERAY

SEQ ID NO: 21 - DNA, 1209 bp, Vibrio cholerae
  CDS (1)..(1209)
atgacggacagccagcagcccaatatcagtaagcctatcagttttgatgtgatcattgcggggggggcaatggcgggggcaacattagcgctcgcgttgcagcacctcagccaaggtaaactgaaggtcgccgtgatagaggcgtttgcgaccgatcattctgcgcatcccggttttgatgcgcgcagcattgcgctctcctacggtacggtacaaatcctgcaggaattacaactttggcctagcctacagccttttgcgactgcgattaaacatatccatgtctcggatcagtctcatgcagggatgacggatattcactgtgagacgcttggggttagcgctctaggttatgtggttgaactggcggatgtggggcgcgtttacgccgagcgcatggctcagtgttctgccatccaacaatttgtgccaagccgagtggtgaatattacccgtgaacaagagtcggtcacggtccaactcaacactaaagagaccttgcaaggtaagctgcttgtggcggcagatggtgcgctgtcgacgtgttgccaagcgctgggccttgcgatgcaggagcacgattttgaacaagtcgcgctgatcgccaatatcaccagcgcgcaacctcatgcagggcgagcttttgagcgttttacaccgcatggccctgttgccttgctaccaatgagccaagatcgcttgtctttagtttggtgtctgccaccagagcaagttgcgcactggctgcattgcagcgaagctgagttcttacaaggcttacaacaagcctttggttggcggcttggcgccttgacccatgcaggtgagagaagtgtttatccactggttttgcgctatcgtgagcaaacggtctctcaccgttttgctattgtgggcaatgcggcgcaaaccttacacccgattgcaggacaaggttttaaccttggtattcgtgatgtggcgactttagccgaagagattacgcgcagcgacgatgcgggtgagtacgcgctactgcagcgttattttcagcgtcgccaagccgatcgcacggcaaccatcagcctgactacaggattagtacacactttctcgaatgactggttagcgatgcgaatggggcgtaaccttggtctaatggcgatggataatttgccgttattgaaagctccgttattgcgccgcactctcggcatagtgaaccgttaa

SEQ ID NO: 22 - protein, 402 aa, Vibrio cholerae
MTDSQQPNISKPISFDVIIAGGAMAGATLALALQHLSQGKLKVAVIEAFATDHSAHPGFDARSIALSYGTVQILQELQLWPSLQPFATAIKHIHVSDQSHAGMTDIHCETLGVSALGYVVELADVGRVYAERMAQCSAIQQFVPSRVVNITREQESVTVQLNTKETLQGKLLVAADGALSTCCQALGLAMQEHDFEQVALIANITSAQPHAGRAFERFTPHGPVALLPMSQDRLSLVWCLPPEQVAHWLHCSEAEFLQGLQQAFGWRLGALTHAGERSVYPLVLRYREQTVSHRFAIVGNAAQTLHPIAGQGFNLGIRDVATLAEEITRSDDAGEYALLQRYFQRRQADRTATISLTTGLVHTFSNDWLAMRMGRNLGLMAMDNLPLLKAPLLRRTLGIVNR

SEQ ID NO: 23 - DNA, 1218 bp, Pseudomonas aeruginosa
  CDS (1)..(1218)
atgcacgcggatctggtcatcgtcggcgccggcatggtcggtagcgccctggccctggccctggagggcagcggcctggaggtgctgctggtggacggcggctcgctcgacgtggcgccgttcaagccggaggcgccctacgagccgcgggtcagcgcgctgtccgaagccagccggcggattctccagcgcctgcatgcctgggacggcatcgtcgcgcgccgcgccgagccctatcgcgagatgcaggtgtgggatggctccggcaccgggcggatcggcttcagcgccgccagcgtgcacgccgaggtactcggccatatcgtcgagaaccgggtggtgcaggacgccctgctggaacgcctgcacgattccaccaccggcctgctggccaatgcgcgcctggaacagatgcgccactccggcgacgactggctgctgaccctggccgacggtcgccagctgcgtgcgccgctggtggtcgccgccgacggcgccaactcggcggtacgccgcctggccggctgcgccacccgcgaatgggattacctgcaccacgccatcgtcaccagcgtgcgctgcgagaacgcgcaccgcgcaaccgcctggcagcgcttcaccgacgacggtccgctggccttcctgcccctgccggaccgcggcgacgagcactggtgctcgatcgtctggtcgaccaccccggaacaggcagaacgcctgatggcgttggacgaggatggcttccgcgccgccctcggcgaagccttcgaacagcgcctgggcgccatcctgcatgccgaccggcgcctgtgcatcccgctgcgccagcggcacgccaagcgttacgtcgagccgggcctggcgctggtcggcgatgctgcgcacaccatccacccgctggccggacagggcgtgaacctgggcttcctcgatgcggcggtgctgtccgaggtcctgttgcacgccctggagcgcggcgaacggcttgccgacgaacgcgtgctgagtcgcttcgagcggcggcggatgccgcacaacctgggcatgatgacggcgatggaaggcttcgagcgcctgttccaggccgaccggttgccgctgcgctggctgcgcaacgccggcctgcgcctggtcgacggccatcacgaggcgaaggcgctgttcgtccgccaggcgcttggcctcagcggcgacctgccgatgctggcacgagtctga

SEQ ID NO: 24 - protein, 405 aa, Pseudomonas aeruginosa
MHADLVIVGAGMVGSALALALEGSGLEVLLVDGGSLDVAPFKPEAPYEPRVSALSEASRRILQRLHAWDGIVARRAEPYREMQVWDGSGTGRIGFSAASVHAEVLGHIVENRVVQDALLERLHDSTTGLLANARLEQMRHSGDDWLLTLADGRQLRAPLVVAADGANSAVRRLAGCATREWDYLHHAIVTSVRCENAHRATAWQRFTDDGPLAFLPLPDRGDEHWCSIVWSTTPEQAERLMALDEDGFRAALGEAFEQRLGAILHADRRLCIPLRQRHAKRYVEPGLALVGDAAHTIHPLAGQGVNLGFLDAAVLSEVLLHALERGERLADERVLSRFERRRMPHNLGMMTAMEGFERLFQADRLPLRWLRNAGLRLVDGHHEAKALFVRQALGLSGDLPMLARV

SEQ ID NO: 25 - DNA, 1185 bp, Neisseria meningitidis
  CDS (1)..(1185)
atgagtttacacagcgacatcctcgtcgtcggcgcaggcccggcgggtttaagttttgcagccgaacttgccggcagcggtttgaaagttaccctgatcgaacgcagcccactgactgttctgcaaaatcctccatatgacggacgcgaaatcgccctgacccatttttcccgcgaaatcatgcagcgtttgggtatgtgggacaaaattcccgaaaacgaaatctaccctttgcgcgatgccaaagtgctgaacggacgttccgactaccagctccactttccccaaccgactgaagcgcgcggcgaacctgccgactgtttgggctatctgatttccaaccacaatatccgccgcgccgcctatgaagtcgtatcacaactcgacaatgtcagcattctgaccgatacggttgtcaaagaagtcaaaacatctgacaacgaagcacaagtcattttggaaaacggcaaaatactgactgcacgcctgcttttggcggcagacagccgcttctcgcaaacccgtcgacaactcggtatctcctccgatatgcacgattacagccgaaccatgttcgtctgccgtatgaaacataccctttccaaccaacataccgcttacgaatgcttccattacggacgcaccatcgcactgctgccgctggaagagcacctgaccaataccgtcattaccgtcgataccgataaaatcaacagcgttcaaaacctttcgcccgaagaattggcggcaagcgtaaaagaacagctcaagggcaggctcggcgatatggaattggtcagcagcatccaccattacccccttgtcggcatgattgccaaacgtttctacggcaaacgcagcgcgctgattggcgatgccgccgtcggtatgcaccccgttacagcacacggtttcaacttggggctttccagcgcagatattttggcaaaactgatactcgaagccgaacagcgcggtcaagacatcggtgcatcttcattattggaaaaatacagcagcaaacatatgctgcacgcccatccgctttatcacggaaccaatatgatgctgaaactgtttaccaatgagaccgcaccggcaaaactgttgcgcggcttggtattgcgtgccagcaacaatttcccaccgctgaagaaactgatcaccaaacaactgaccggttga

SEQ ID NO: 26 - protein, 394 aa, Neisseria meningitidis
MSLHSDILVVGAGPAGLSFAAELAGSGLKVTLIERSPLTVLQNPPYDGREIALTHFSREIMQRLGMWDKIPENEIYPLRDAKVLNGRSDYQLHFPQPTEARGEPADCLGYLISNHNIRRAAYEVVSQLDNVSILTDTVVKEVKTSDNEAQVILENGKILTARLLLAADSRFSQTRRQLGISSDMHDYSRTMFVCRMKHTLSNQHTAYECFHYGRTIALLPLEEHLTNTVITVDTDKINSVQNLSPEELAASVKEQLKGRLGDMELVSSIHHYPLVGMIAKRFYGKRSALIGDAAVGMHPVTAHGFNLGLSSADILAKLILEAEQRGQDIGASSLLEKYSSKHMLHAHPLYHGTNMMLKLFTNETAPAKLLRGLVLRASNNFPPLKKLITKQLTG

SEQ ID NO: 27 - DNA, 909 bp, Rickettsia prowazekii
  CDS (1)..(909)
atgagtcaaatagaaacagataagatgttaaatatagtaattttagggtgcggtctcagtggtatgctaactgcactttcttttgcacacaaaggtataaaaactactatattagagcgtaaactggtaaaaagccaagattttttaaaagatataagaactactgcgttaacgccgtattctaaaaagtttttattctctattgggatatggaaagagctggaacagtttgtagcagaaatgcaagacgtatatgttgtagataataaggcttcagaaatattagatttatgtaataagaatgatgctgtacttggatatgttgttaagaatagtgattttaaaaagatattattgtcagaaataactaataattcgttgataacattaattgataataatcaatatcaagaagtgataagccataatgattattcgattataaaatttaataatgataaacaaattaagtgtgatttattaattatatgtgacggagcaaattcaaaagtaagatcttattatttcactaatgaaattgataaaccttatcaaactgctctaacttttaatgttaagcatgaaaagccgcatgaaaattgtgcgatggagcattttcttcctcttggtccttttgctttgctacctttaaaagatcaatatagttcttccgtaatatggtccacttctgttgttcaagctgctttaattattaatttgcctacaaaagaagttgattttttaattcaaagaaatgttggtaatttcttaggtcaaattactattgagagtgagattagtagctttccactaaaagcttttatagcaaacagatattttcataatcgtatagtgcttattgccgacactgcacacatcgtacatccgcttgccaggacaaggacttaa

SEQ ID NO: 28 - protein, 302 aa, Rickettsia prowazekii
MSQIETDKMLNIVILGCGLSGMLTALSFAHKGIKTTILERKLVKSQDFLKDIRTTALTPYSKKFLFSIGIWKELEQFVAEMQDVYVVDNKASEILDLCNKNDAVLGYVVKNSDFKKILLSEITNNSLITLIDNNQYQEVISHNDYSIIKFNNDKQIKCDLLIICDGANSKVRSYYFTNEIDKPYQTALTFNVKHEKPHENCAMEHFLPLGPFALLPLKDQYSSSVIWSTSVVQAALIINLPTKEVDFLIQRNVGNFLGQITIESEISSFPLKAFIANRYFHNRIVLIADTAHIVHPLARTRT

SEQ ID NO: 29 - DNA, 1197 bp, Xylella fastidiosa
  CDS (1)..(1197)
atgtcgcaacagcgtatgaaccgaactcaccgacccgatgtactcatcactggcggcggcgtcgtcggtgccagcagcgccctggcattggcgaaaacagggttacacgtcgccttgattgaaaaatgcgaaccgccgcgttggcaagcaacggctccggatctgcgtgtctacgcatttgccccggacagtgccgcactcctgcgcaccttcaacgtatggccgaccgtgtgcgcgacacgcgcccagccataccatcgcatgcggatctgggacagtggcggagggggcgaattgcacttcgacgctgccacattgggccgcgaacaactcggctggatcgtcgagaacgcactcctagtcaaccagttgtggtccgcacttgcggaggccggcgtacaactacattgcccggcaaggatcaccgccctagagcaagacaccgacagagtgcgtttacgcttggaggacggtcgccgactcgaagcacgcctggccatcgctgccgacggcgccgactccaccttgcgtcaattggcacacctgccagtacaccgacatgactatgcacaacgcagcattgtcgcctttgtcgcaaccgaacacccacaccaagccaccgcctggcaatgcttcctaccaagcggaccattggcattgctaccatttactgatgagcgcagctcaatcgtctggacgctccccgatgccgaagcgcaacgtctcctggcactggacgaaacaacattcgcacgcgaactcaccactgccttcggtgggcgcctaggacacatacagctcatctcaccacgcaccgcattcccactgcgccgccaactggccaccgactacatcgccggacgggtactgacactcggtgacgcagcacatgtcgtccacccactggccggacagggcgtcaacctcggcttgcgcgatgtaaccgcattgcaaaccctgatccaacaggcacacacgcgccatgttgactgggccacaccgcaccgcctgcaacgctgggcacggacacgccgcagcgataacaccctcgccgcctacacgttcgatgccattaaccgggtattctccaacgacgcatttcacctcaccctgctacgtggccgtgtactgggcctggtcgaccgcctaccaccgctcgtcaacgccctatggcgtcgcgcttcgggagtgaattga

SEQ ID NO: 30 - protein, 398 aa, Xylella fastidiosa
MSQQRMNRTHRPDVLITGGGVVGASSALALAKTGLHVALIEKCEPPRWQATAPDLRVYAFAPDSAALLRTFNVWPTVCATRAQPYHRMRIWDSGGGGELHFDAATLGREQLGWIVENALLVNQLWSALAEAGVQLHCPARITALEQDTDRVRLRLEDGRRLEARLAIAADGADSTLRQLAHLPVHRHDYAQRSIVAFVATEHPHQATAWQCFLPSGPLALLPFTDERSSIVWTLPDAEAQRLLALDETTFARELTTAFGGRLGHIQLISPRTAFPLRRQLATDYIAGRVLTLGDAAHVVHPLAGQGVNLGLRDVTALQTLIQQAHTRHVDWATPHRLQRWARTRRSDNTLAAYTFDAINRVFSNDAFHLTLLRGRVLGLVDRLPPLVNALWRRASGVN

SEQ ID NO: 31 - DNA, 1245 bp, Synechocystis sp
  CDS (1)..(1245)
atgacctttgtagccgcttccataactgataaccaattcgatgtggcgatcgccgggggaggcgttgtggggctggtactagcggcgggtttgcgtcatacggggctgaaaattgccattatcgaagctttaccgaaggaacaggccctaactaagccccaggcctatgccatttccctgctgtcgggcaaaatcttagcgggactgggggtctgggaaaatattaaggactccatcggtcatttcgaacgcatccaaatttccgataatgactatcggggtaccgttccctttgccaaggaagatgtggacgaactggccctgggccatgtggcggagcatccagtcattctgcaggcgctggaaaattgtgtagagcaatgtccccgcattgcctggtttcgtcccgctgagttgatcagttttacggcgggagagaaccacaaacaggtcaccctacaacaggaaggcagagaaattaccctacaaaccaaattgttggtggcggcggatggagcccgttcccacacccgttccctggcggggattcaaaccaaggggtggaaatattggcaatcctgtgtggctttcaccatccagcatcaagcccctgacaataccactgcctttgagcgtttttgtgacactggtcccatggggattttgcccctacccggcgatcgagcccagattgtctggaccatgccccaccataaggcccataccctagtgaatctaccggaagcggattttattacagaactgcgccaacgcattggcgatcgcctaggggaatttcatttaattaatgcccgccgtttatttccggtgcaactaatgcagagcgattgttatgtgcaaccccgcttggcattagtgggggatgcggcccactgttgccatccggtggggggtcagggtttaaatttgggcattcgggacggagccgccctggcccaggttattgccacggcccacagccaaggggaagattggggttccctagcagtgctgaaacgttatgaacattggcgtaaaccagaaaattggctcattttgggcttcactgacctgctagatcgtttcttttccagtcattggctgccggcgatcgccttgagaaggtttggcctagaggtattgcgcctagtgcctccagcgaaaaagctggccctccgtttgatgaccggtttgctcggtcggaaaccccaattggccacagggcaatccttagtgagtcagtag

SEQ ID NO: 32 - protein, 414 aa, Synechocystis sp
MTFVAASITDNQFDVAIAGGGVVGLVLAAGLRHTGLKIAIIEALPKEQALTKPQAYAISLLSGKILAGLGVWENIKDSIGHFERIQISDNDYRGTVPFAKEDVDELALGHVAEHPVILQALENCVEQCPRIAWFRPAELISFTAGENHKQVTLQQEGREITLQTKLLVAADGARSHTRSLAGIQTKGWKYWQSCVAFTIQHQAPDNTTAFERFCDTGPMGILPLPGDRAQIVWTMPHHKAHTLVNLPEADFITELRQRIGDRLGEFHLINARRLFPVQLMQSDCYVQPRLALVGDAAHCCHPVGGQGLNLGIRDGAALAQVIATAHSQGEDWGSLAVLKRYEHWRKPENWLILGFTDLLDRFFSSHWLPAIALRRFGLEVLRLVPPAKKLALRLMTGLLGRKPQLATGQSLVSQ

SEQ ID NO: 33 - DNA, 1401 bp, Schizosaccharomyces pombe
  CDS (1)..(1401)
atgcctactatcagtccaactttaggaatatacacgaggaagtttgcaagccaaaaaatacttcaacgtcaattcgatgttgttatagtaggatccggtcctgtcggactggctttagctgctggactacagagtaatcccgtaactcaatcactcaaagttgggcttttggacattcaggatacgatgaaattaaaggattggaagtttgaaacgtactctaatcgttgtagctctttaacgaatcatacccgcatgttttttgacaaaattggtgcttgggattttgctcgcaaggatcgcatccaacctttccaacacattcttgcctctgatggtctaactaattcctccatacatcttgatcaaaaaccaggaagtgaacccatggctttcatgtcggaaaacgtcaatttgcaatacgcccttttgaattctatcatcgataaaatgaataacaatattaaaaaacctaatttagaatttttaatgccttgcactattactaagctttctaaaggagaaaatatctatagaacgcatattcatacaacaactcatggtgaattaacaacgaagctcttaattggtgcggatggaagaaattcaattgttcgcaaatacgcaaatatttccatgccagggtggaactatcttactcatgctgtggtcgggacacttaaaattgatccgttaaaaggacctgccgtagctttccagcgatttttacctaccggtcctttagcttaccttcctttacctgacaacaatgctaccttcgtatggagtacgcggccacatattgcatcaaaacttcttcgtcttccagaagaaacttttgttaagtttttgaatgcatctttccgcctggattatcccgatttaagctatttgtatcaaatggatttttctgagccttccaaagttaatgaacagttggattggaggttgcaagttaagagaaattctaatatgcaggtccctcctgttataaccgaaattgtttctggttctagggcggcatttccgttgagacttgcccatgttgatgaatatgtaaaagaaggaattgccctttgcggggacgctgctcataacactcatccattagctggacagggattaaatactggaattcaggatgttgaatctttaatatcagcactctcttttgctatcaagcacggtcaggatattggtagtgttttttcactccaaccgtatttccgtgaccgttacttcaaaaaccatgtttatctaggagtcgttgataagttccacaagctgtacgcaatggaaaatccggtggtcacttctgtacgaacccttggactttcattatttgatcgcagtgctagcttgaaaaacttcattctttctacggtagctaatggaatttag

SEQ ID NO: 34 - protein, 466 aa, Schizosaccharomyces pombe
MPTISPTLGIYTRKFASQKILQRQFDVVIVGSGPVGLALAAGLQSNPVTQSLKVGLLDIQDTMKLKDWKFETYSNRCSSLTNHTRMFFDKIGAWDFARKDRIQPFQHILASDGLTNSSIHLDQKPGSEPMAFMSENVNLQYALLNSIIDKMNNNIKKPNLEFLMPCTITKLSKGENIYRTHIHTTTHGELTTKLLIGADGRNSIVRKYANISMPGWNYLTHAVVGTLKIDPLKGPAVAFQRFLPTGPLAYLPLPDNNATFVWSTRPHIASKLLRLPEETFVKFLNASFRLDYPDLSYLYQMDFSEPSKVNEQLDWRLQVKRNSNMQVPPVITEIVSGSRAAFPLRLAHVDEYVKEGIALCGDAAHNTHPLAGQGLNTGIQDVESLISALSFAIKHGQDIGSVFSLQPYFRDRYFKNHVYLGVVDKFHKLYAMENPVVTSVRTLGLSLFDRSASLKNFILSTVANGI

SEQ ID NO: 35 - DNA, 1479 bp, Debaryomyces hansenii
  CDS (1)..(1479)
atgcttttaaaatcatttgctagatcactagcaacagctgcgtctatcagctctccaaagtttcaggacgtagtagtaataggtgggggaccagctggattatcgttgttagcagctttgaaaaattctcataagacgaaacatttaaaatgtacattggtggaagggtcgagtttagaatctgttcgtgactttggtataaacccaccggatgagtataccaacagagttgtttcattgacccctaaatccgtagaattcatgcaagaaaaaattggaaattgggactacatagaccaggacagaatcaagttctatgataatattgtcgcttatgattcccaagataaagaatcacgtataagatttgatggaagtagcgttggtgttggtgttttggcggcaatgtgtgaaaatgtaaatattcaaagttcattgatatcgaagattgacgacttaaatgacaatattaaggatccaagcattgagcaagaagctgttatattagataatactaaggttgttgaaattattaatccgaaagaagaaaatacccatgaactattggaaaacgacccagaagcaggcaacccagaaatcgactggccaattgtcaagctttcgaatggagatgttttacaaacaagattattagtgggtgcggacggttttaactctcctgttcgtaaattttcccatatcccatctaggggttggtcgtataatagattcggtgtcgtagccactatcaaacatcaatatgaagactaccggtcaattgcatggcaaagattccttacaaccggaccacttgctattttgccattaactgaagacaatgctactattgtttggtccaccacccctgagttgtctgaattatttttaaaggtggatgaagagatcttccctcacttgattaacgcagccatgaccttatctgaggttgatttgaattatatttatgaacaattgaagaaagatccaaatgacaagtcagttcttgaggacatagagtggcgtatgtcgaaaataaagctctctattttggaagaaaaatatccgttacaggttactacagtggtggagaactctagagctagatttccattgaaattatcccatgctgatacatatgcaattcctcgtattgcattaattggagacgctgctcacactgttcatccattagcgggacagggtttgaatatgggacaatcagatgtagcatgtttactcgaggctcttgaagatggggtgaacagaggccttgacattggttcaacattagtgttggaaaattatactgctaatgcatggcctgccaatcatgtattgatgggtgtttgcgataaattgcataaaatattttcaactgattggttccctattgtcttccttagaggttttggtatgaaatcgttaaatatagtcgatactgccaaagatttaatgataaaggctatcagtggtagatag

SEQ ID NO: 36 - protein, 492 aa, Debaryomyces hansenii
MLLKSFARSLATAASISSPKFQDVVVIGGGPAGLSLLAALKNSHKTKHLKCTLVEGSSLESVRDFGINPPDEYTNRVVSLTPKSVEFMQEKIGNWDYIDQDRIKFYDNIVAYDSQDKESRIRFDGSSVGVGVLAAMCENVNIQSSLISKIDDLNDNIKDPSIEQEAVILDNTKVVEIINPKEENTHELLENDPEAGNPEIDWPIVKLSNGDVLQTRLLVGADGFNSPVRKFSHIPSRGWSYNRFGVVATIKHQYEDYRSIAWQRFLTTGPLAILPLTEDNATIVWSTTPELSELFLKVDEEIFPHLINAAMTLSEVDLNYIYEQLKKDPNDKSVLEDIEWRMSKIKLSILEEKYPLQVTTVVENSRARFPLKLSHADTYAIPRIALIGDAAHTVHPLAGQGLNMGQSDVACLLEALEDGVNRGLDIGSTLVLENYTANAWPANHVLMGVCDKLHKIFSTDWFPIVFLRGFGMKSLNIVDTAKDLMIKAISGR

SEQ ID NO: 37 - DNA, 1419 bp, Kluyveromyces lactis
  CDS (1)..(1419)
atgttgtctagccggattttgagcaggtctttttttgcgtctgctgttaaccttcaagctaagttaacagatgtgcttattgttggcggtggtcctgccgggttgacattggctgctgctatcaaacaatctccccacttatcggatctatcaactgtattggtcgatgcaggtgatttgaaggaaaaaataggcggtttctaccatgatccaccagacaatttcaccaatagagtgatcagtttaacaccccaatctaagcacttcttagagaatactgttggggtatcgttgatggaagagagaattcagccctttgatggtctatacgttacagatggatgctctaatggtactttagagatggaacgggattcaatggggtttatggttgaaatcttgaacattcaaagttcgttgttggcgaaactacgttcaagtaatgcaccaaatttggatcttattgacaaaacaaaagtccaaagtattgaatatgaagatcccgaagatactaaatcatggccggtggtgaccctagacagtggggaacaatataagacacgcttgttgataggtgccgatggattcaacagtccagttcggaaattttctgggattgagtcaagaggctggttttacgagagattcggagtcgtagctaccttgaaactagaatatcctccgttcaaaattagaggatggcaaagattcttaccaactggaccagtggctcatcttccattaccaggtacgaactctacgttagtttggagtaccactgaaccattatcaagattgttattatctttggatgacgacgtatttgtggccttggtcaacgcagcgttcatcttggaggacgttgatctcgaatattactataagtccttacaggagggaactattacgggcgaagaattgattcaagatgttgacttcagaatcaatgagaaatttaattcattcaaagacgactctgtcatcgacgaaaaatacccccctaaggtgattgacatcttggataaatcaagagggagattcccactaaaactctctcatgctgacacatatgtcgctgaaagaattgcccttgttggcgatgcagcacatacgacacatccattggcaggtcaaggcttgaatatggggcaaggtgatgtggagtctctcattaaagcattggaaaaggctagacaaagaggattagacattggttctctgttggctttagaaccgtactgggcagaccgctatcctaccaacaacatgttactaggtgtggtagacaagctacataagctatactctacagatttcggtcctctagtttccttgagaacgtttggcttaaatttagtcaacagcttacaacctttgaaagatctgatggtaggaaaagttagcggaccaagtaaatag

SEQ ID NO: 38 - protein, 472 aa, Kluyveromyces lactis
MLSSRILSRSFFASAVNLQAKLTDVLIVGGGPAGLTLAAAIKQSPHLSDLSTVLVDAGDLKEKIGGFYHDPPDNFTNRVISLTPQSKHFLENTVGVSLMEERIQPFDGLYVTDGCSNGTLEMERDSMGFMVEILNIQSSLLAKLRSSNAPNLDLIDKTKVQSIEYEDPEDTKSWPVVTLDSGEQYKTRLLIGADGFNSPVRKFSGIESRGWFYERFGVVATLKLEYPPFKIRGWQRFLPTGPVAHLPLPGTNSTLVWSTTEPLSRLLLSLDDDVFVALVNAAFILEDVDLEYYYKSLQEGTITGEELIQDVDFRINEKFNSFKDDSVIDEKYPPKVIDILDKSRGRFPLKLSHADTYVAERIALVGDAAHTTHPLAGQGLNMGQGDVESLIKALEKARQRGLDIGSLLALEPYWADRYPTNNMLLGVVDKLHKLYSTDFGPLVSLRTFGLNLVNSLQPLKDLMVGKVSGPSK

SEQ ID NO: 39 - DNA, 1179 bp, Erwinia carotovora subsp
  CDS (1)..(1179)
atggcggtcatgattgtcggtggtggaatggcgggcgcgacgctggcgctggcgatatcacggctctcacagggcacaataccggttgaccttatcgaggcatactcaccactcgacaaggaacacccgggttttgacgcgcgtgccctcgcgctgtctgatggcacacgccagcagctagcggcgctgggtatctggcaagcgatgtctggcaatgcaacagcgataaccgacattcacgtcagcgaacgcgggcatgccagcgtagtgaatctgcacgcggcggattatcacgttcaggcattgggccatgtggttgaactgcacgacgtcgggcagcgtctgttttccctgctgcaacaggcgcccggcgtgcgtctgcactgcccagccaaagtggttgccgtcacgcggacgcaagagaacgccacgctaacgttggataatggcactgcgctcacaggccaactgctggttgccgccgatgggtcacattctatgctgtcgcagtcctgcgggattcattggcaacagcatgagtatgatcaggtcgcggtgatcgccaacgtgacaaccggcgaaccccatcgcgggcgcgcatttgagcggtttaccccgcacggtccactggcgctgttaccgatgagtaacggtcgcagctcactcgtctggtgccatgataaacatcgtcaacacgacgtcgatggatggagcgaaaccgagtttcgccaacagctacagctggcttttggctggcgtctggggcaattcacccacatcggcgaacgccatagctatccgctacgcttgctaaccgccagccagcacaccagccatcggctggcgctggtgggcaacgcggcacaaacgctgcatccgattgccggacaaggctttaatctgggaattcgcgatgtcatgtcgctggcagaaacactcgtcgaggcggtgaaaaaccagcaggatatcggccaatacagtgtgctcagccgctatcagcaacgccgcgaacccgatcaacacaccaccgtcgcgatcaccgatggtctggtcaggctatttgctaaccgctataccgcgctggcggtcggccgcaatctgggcctgatcgccatgaataacctgccgctgatgcgcgatgcgtttgcccgtcgcacactgggctgggtagaacgttaa

SEQ ID NO: 40 - protein, 392 aa, Erwinia carotovora subsp
MAVMIVGGGMAGATLALAISRLSQGTIPVDLIEAYSPLDKEHPGFDARALALSDGTRQQLAALGIWQAMSGNATAITDIHVSERGHASVVNLHAADYHVQALGHVVELHDVGQRLFSLLQQAPGVRLHCPAKVVAVTRTQENATLTLDNGTALTGQLLVAADGSHSMLSQSCGIHWQQHEYDQVAVIANVTTGEPHRGRAFERFTPHGPLALLPMSNGRSSLVWCHDKHRQHDVDGWSETEFRQQLQLAFGWRLGQFTHIGERHSYPLRLLTASQHTSHRLALVGNAAQTLHPIAGQGFNLGIRDVMSLAETLVEAVKNQQDIGQYSVLSRYQQRREPDQHTTVAITDGLVRLFANRYTALAVGRNLGLIAMNNLPLMRDAFARRTLGWVER

SEQ ID NO: 41 - DNA, 1212 bp, Erwinia carotovora subsp
  CDS (1)..(1212)
atgcaatcattcgacgtggttattgccggtggcggtatggtcggtctggcgctcgcctgcggcctacagggtagcggcctgcgcatcgccgtgctggaaaaacaggcagccgagcctcagactctcgggaaaggtcatgcgctgcgcgtctctgctatcaatgccgcgagcgaatgccttcttcgtcatattggcgtctgggagaatctcgtggcgcagcgcgtcagtccttacaacgatatgcaagtctgggacaaagacagcttcggcaaaatcagctttagcggtgaagaattcggcttttcccatcttgggcatatcattgaaaacccagtgattcaacaagtactgtggcaacgcgcctcccaattaagcgacatcaccctgctctcccctacgtcattaaaacaggtcgcctggggtgagaacgaagcctttattacgctgcaggacgacagcatgctgactgcccgactggtggtcggcgctgacggtgcacattcatggctgcgtcagcatgcggatattccgctgaccttttgggattacggccaccacgcgctagtcgccaatattcgtaccgaacacccacatcagtccgtagcacgtcaggcattccatggcgacggtattctagcgtttctgccgctggacgatccgcacctctgttcgattgtctggtcactttcgccggagcaggcactggtgatgcaaagcttgccagtggaggaattcaaccgtcaggttgcgatggcgtttgatatgcggttggggctgtgtgaactggaaagcgagcgtcagactttcccgctgatgggacgttatgcacgcagcttcgccgcgcaccggctggtgctggtcggcgacgcagcacacaccatccacccgctggcaggacaaggcgtcaatctaggcttcatggatgtcgccgaactgattgccgagctgaagcgcttgcagacgcagggtaaagatatcggccagcacctttatctgcgacgctatgaacgccgccgcaagcacagcgccgccgtgatgcttgccagcatgcagggattccgtgaactgtttgacggcgacaatccagcaaaaaagctgctgcgtgatgtcggtctggtactggcggacaaactacccggtattaaacccacactggtccgtcaggcaatgggattacacgatctgccagactggcttagtgctgggaagtaa

SEQ ID NO: 42 - protein, 403 aa, Erwinia carotovora subsp
MQSFDVVIAGGGMVGLALACGLQGSGLRIAVLEKQAAEPQTLGKGHALRVSAINAASECLLRHIGVWENLVAQRVSPYNDMQVWDKDSFGKISFSGEEFGFSHLGHIIENPVIQQVLWQRASQLSDITLLSPTSLKQVAWGENEAFITLQDDSMLTARLVVGADGAHSWLRQHADIPLTFWDYGHHALVANIRTEHPHQSVARQAFHGDGILAFLPLDDPHLCSIVWSLSPEQALVMQSLPVEEFNRQVAMAFDMRLGLCELESERQTFPLMGRYARSFAAHRLVLVGDAAHTIHPLAGQGVNLGFMDVAELIAELKRLQTQGKDIGQHLYLRRYERRRKHSAAVMLASMQGFRELFDGDNPAKKLLRDVGLVLADKLPGIKPTLVRQAMGLHDLPDWLSAGK

SEQ ID NO: 43 - DNA, 1233 bp, Acinetobacter sp
  CDS (1)..(1233)
atgacacaaatcgcagatgtggtaattgtaggtggtggattggttggtggcctaacggcattgctgcttgcccaaggtggtgttcaagcgactgtactggatgctgcgcccatacttgatactgcaaaagttgaaagtgtgatgaacccgcgtgtgcttgcactgagtcaggcaacaattcatctgcttaaaaccgttgaggtatgggagcttatttcacggcaaatgccttatacagggatgcaggtgtggaataaaaatggctatggtgatattcaatttggacatcacagcgcctcaacgcctatgattgatcaggcactgggttctatggtcgaacctagtttattgaatcttgcgattcagcaaaaaatgagagccgttattcaggattatcgaaccgaggttcaggttgttcagattgaacaactgccaaatctttggcagatccatctggctgatggtcattgtatccagacacgattattaattggtgccgatggcgcaaattcgttcgtacgcgaaaaggccatgattgatctggatgtacttgactataaacaagcagcaataagctgtgcgataaaaacagcgctctcgcatgagcatgtcgctcgtcaaatttttctgccaacagggcctttggcctttttgcctatggcaagtctcgttccagccgagcagggtttgtggcaatcgattgtttggaccttaccagatgattatgcagatgagtattcagcgctgtcggatcatgaatttaaagcgttgctaactcgtgagagtcagcacatgctaggtgaggttgttgaagtccgatcaagagctcaatttccattaaaagctcgtgcagcaaaacaatatgtgaaagagggtctggcattgattggtgatgccgcgcatgtgatccatcctcttgctggacaaggcgtaaacattggctgtctggatgctgcggttttgtgtgatgcattactgcatgatcgtgcgcgtggtgtctgggctcatgagcaaactttgagacgctatgaacatgagcgtaaaggtcaaaatgatgccatgatgcatggcatgtcgatcattggctggctagaaagtcaggagtttttcccgctcattgcactacgcaacacagggttacgatgggtcgaaaacagtgaaattcttaaaaattcatttttgcaacaagcgacgggattaagcattttaaataagactcggtatgtgtcttga

SEQ ID NO: 44 - protein, 410 aa, Acinetobacter sp
MTQIADVVIVGGGLVGGLTALLLAQGGVQATVLDAAPILDTAKVESVMNPRVLALSQATIHLLKTVEVWELISRQMPYTGMQVWNKNGYGDIQFGHHSASTPMIDQALGSMVEPSLLNLAIQQKMRAVIQDYRTEVQVVQIEQLPNLWQIHLADGHCIQTRLLIGADGANSFVREKAMIDLDVLDYKQAAISCAIKTALSHEHVARQIFLPTGPLAFLPMASLVPAEQGLWQSIVWTLPDDYADEYSALSDHEFKALLTRESQHMLGEVVEVRSRAQFPLKARAAKQYVKEGLALIGDAAHVIHPLAGQGVNIGCLDAAVLCDALLHDRARGVWAHEQTLRRYEHERKGQNDAMMHGMSIIGWLESQEFFPLIALRNTGLRWVENSEILKNSFLQQATGLSILNKTRYVS

SEQ ID NO: 45 - DNA, 1209 bp, Acinetobacter sp
  CDS (1)..(1209)
atgcaacagcaagtcattattgtgggtgggggaatggtcggactgagtctggctttaatgttggcgaagcaaaaaatcgcggtcaaacttttggaagcaatacgttatccagattacgacgatgcgaatctggcgccttatcactccagttttgatgcacgtaatactgcgctttcacgccgtagtgtacaaatttatcaaaaattagagttgtggaatgcacttcagcagcatgctaccccaattttgcaggttcatattacagagcagggaagttttggtaaggcacgcttgactgccgaacaagagaaagtcgaaagttttgggcaagtcattgaaaatgcctggcttggtcgggtgttgcttaccgaggttcgcgagcaaaccttgattgagctgattgatgggattgaagtgacggcattgcatcaagacgctgaaaaggtctttattgaggccaaacgtggtgatgaacagcttagtttaagcagtcagttagtaattgctgcagatggccgtgattccttttgtcgtcaagccttaggtattggtgccgatgtgcatgattatgatcaagttgcaattgtcaccgcagtacagacatctaaaccacatcaacatattggttttgaacgttttagcgagttggggcctttagcattactcccattgccaggagagtatcgtcgatctgtggtatggcctgtgaaaaaaggtacagaaagtgaatggctgggtgaagataacgatcagcattttttgaatgccttgcaacagacttatggcgatcgtgcagggaaatttgaaaaaacgggtaaacgttttagttatccattgtctcaggtactcgcgcacaaacaggcggtgggtcgggtggtattgatgggaaatgcagcacataccattcatcctgttgcagggcagggttttaatttatgtttgcgtgatgcagatgttctggttcgttatttattacaacagttagcgacttcgaatgatatcggtcaaccagaaaacctgttggcgtatgagcaggcgcgtttaaaagatcagcagcgtgtaattcggttttgtgattctgttgtccgtggttttagtcatcaaaatcctattcttaagttattgcgtaatactggtttgattgcttttgatgtgattcctggaatcaagccgttggttgccaattacgctatgggattaaaagcatga

SEQ ID NO: 46 - protein, 402 aa, Acinetobacter sp
MQQQVIIVGGGMVGLSLALMLAKQKIAVKLLEAIRYPDYDDANLAPYHSSFDARNTALSRRSVQIYQKLELWNALQQHATPILQVHITEQGSFGKARLTAEQEKVESFGQVIENAWLGRVLLTEVREQTLIELIDGIEVTALHQDAEKVFIEAKRGDEQLSLSSQLVIAADGRDSFCRQALGIGADVHDYDQVAIVTAVQTSKPHQHIGFERFSELGPLALLPLPGEYRRSVVWPVKKGTESEWLGEDNDQHFLNALQQTYGDRAGKFEKTGKRFSYPLSQVLAHKQAVGRVVLMGNAAHTIHPVAGQGFNLCLRDADVLVRYLLQQLATSNDIGQPENLLAYEQARLKDQQRVIRFCDSVVRGFSHQNPILKLLRNTGLIAFDVIPGIKPLVANYAMGLKA

SEQ ID NO: 47 - DNA, 1434 bp, Candida glabrata
  CDS (1)..(1434)
atgttgaagatgcaattgagttctgtcaggtacttagctaccatagctaaaaactcaacccccaaattgaccgatgtcctcattgtaggtggtggtcctgctggtcttacgcttgctgcagcaatcaagaattctccaactttagccggtctttcaactacgttagtagacgctggggatttgaagaaagttggggaatttcacgaccaaccaccagagcatttcaccaatagagtcgttagtataactccaaagtctctgcatttcattgccgaaagggctggtgctggtgatttcttactaagggacagaatccaaccttatgatggtttatatgtcaccgatggtgtcaccaagtctttgctcgatttggaaaagccctctatgttggaaatgattgaaatcttgaacatccaatcaagtttactcaagaaattatcgcagtatgatgaagtacttgatggatttaagcttgtggaaaaatctaaagtcactaagattgaaaacaccgatcctaaagacccaacttcatggccattagttactcttgataatggtgatgtttacaaaaccagattactagtcggtgctgacggattccaatcaccagtaagaaaatttgcaaatattgaaactcgtgggtggttctatggtacttttggtgttgttgctacaatgaaactacaatacgacacatataagctaaggggctggcaaagatttctaccagatggtccaatcgctcatttaccattaccaggtgaaaatgcaactcttgtgtggactacaactgaaagaatttcaaagttgctattgacattggatccaaaggcatttgcctccttggtcaatgccgcttttgttcttgacaacaccgacttacaatattattttgatgagttggaagccggaaagatttcaacaaatgaactcattgaggatgttaaattcagaatggaccaagaattttcaaaactaagcgatgaaactatgatagacgaactctacccaccccaggttattgacataaagggtgacactagggccaggttcccactgaagatgacgcatgctgacaactactgttcgcatagggtggctttggtaggtgatgcagctcataccactcacccactagctggccaaggtttgaacatgggtcaaggtgatgtcgaagctcttgttgacgccttagagaaagctacacaaagaggtcaagatattggtgctctattgagcctggaaccattctgggctgagcgttacgctactaaccatgtgctactaaatatggccgataaactatacaaactttaccacactgattcagcacctgtagtagcattaagaagtcttggcctcgatttaaccaataacttcccacctgtgaagaactggattgtgaagactctgactgccgacactgaattttga

SEQ ID NO: 48 - protein, 477 aa, Candida glabrata
MLKMQLSSVRYLATIAKNSTPKLTDVLIVGGGPAGLTLAAAIKNSPTLAGLSTTLVDAGDLKKVGEFHDQPPEHFTNRVVSITPKSLHFIAERAGAGDFLLRDRIQPYDGLYVTDGVTKSLLDLEKPSMLEMIEILNIQSSLLKKLSQYDEVLDGFKLVEKSKVTKIENTDPKDPTSWPLVTLDNGDVYKTRLLVGADGFQSPVRKFANIETRGWFYGTFGVVATMKLQYDTYKLRGWQRFLPDGPIAHLPLPGENATLVWTTTERISKLLLTLDPKAFASLVNAAFVLDNTDLQYYFDELEAGKISTNELIEDVKFRMDQEFSKLSDETMIDELYPPQVIDIKGDTRARFPLKMTHADNYCSHRVALVGDAAHTTHPLAGQGLNMGQGDVEALVDALEKATQRGQDIGALLSLEPFWAERYATNHVLLNMADKLYKLYHTDSAPVVALRSLGLDLTNNFPPVKNWIVKTLTADTEF

SEQ ID NO: 49 - DNA, 1281 bp, Bartonella quintana
  CDS (1)..(1281)
atgtattctgatctcaatgaaggtataaaacccaataaaaacacaagagccaataaaaaaaaagaacaatgtgatctcctcattgcaggtggcgcggctgtcggtttaacgctggcagtagcgctcaaacaagctgcccctgatttgaaaattaagatcgtcgatgctgttcctcaaggagatatccctgtttccaatatacgcgcacttgccctttctgctgcctctattcgtatgttgaaacaactgcaatgttgggaacatataaaatctcatgctcaacctattcattcaatgatcatcacagatgcatacacaaatgatcctgtcaaaccaactcttttaacctttgaaggaaatgttacccccaacgagccctttgctgctatggtggaacatagagagctcctcaatgctttaaaaaagcgtgcaaaagatctaggtattcctttcctcgcaaacatgcgtattattgattttcaccaaaaagatcaacacaccactgtcactttaagcaatgaagaaatctggcaaacgaaattgctaattgcagctgacggagcacattcggaattacgcgaaaaagcaggtcttaaaaatttttctcgtccctataaacaaacagcaatcatctgcacgattgaacatgaaaaaccccatcatggtcaagcaatccaacatttcttacctgctggccctttcgctcttctccctctcaaaggaaatcgatcagccgtggtatggaatgaacagaataaaactgcgcaatattatttcaaagctgatgctcttatttttgaaacagaaatcaaaaaacgtattggtcaccgatatggaaagctcacttggaatggggaacgccaagcctttcctttaaagctttctttagcacgccaatgtattaaaccgcgctttgttctcattggtgatgctgcgcatacaatccaccctcttgcaggacaaggcctcaatttaggattacgcgatagtgccgcactcgccgaagtgattattgaaacagcgcggttaggtcttgatattggatctttcattgctctcgaacgctatcaaagctggaggcgttttgaaactgtacgtatggctctgagcaatgactggcttaaccaactcttttctaatgataacctgctcttgcgaatgctccgcgatgttggtcttggaattgtcaatcaaacgccaaaaatgaaaaaatatttcattcaagaagcctccggtctcacccgtcatgccccacgtctgctgcacggattgccactctaa

SEQ ID NO: 50 - protein, 426 aa, Bartonella quintana
MYSDLNEGIKPNKNTRANKKKEQCDLLIAGGAAVGLTLAVALKQAAPDLKIKIVDAVPQGDIPVSNIRALALSAASIRMLKQLQCWEHIKSHAQPIHSMIITDAYTNDPVKPTLLTFEGNVTPNEPFAAMVEHRELLNALKKRAKDLGIPFLANMRIIDFHQKDQHTTVTLSNEEIWQTKLLIAADGAHSELREKAGLKNFSRPYKQTAIICTIEHEKPHHGQAIQHFLPAGPFALLPLKGNRSAVVWNEQNKTAQYYFKADALIFETEIKKRIGHRYGKLTWNGERQAFPLKLSLARQCIKPRFVLIGDAAHTIHPLAGQGLNLGLRDSAALAEVIIETARLGLDIGSFIALERYQSWRRFETVRMALSNDWLNQLFSNDNLLLRMLRDVGLGIVNQTPKMKKYFIQEASGLTRHAPRLLHGLPL

SEQ ID NO: 51 - DNA, 1281 bp, Bartonella henselae
  CDS (1)..(1281)
atgtactctgatctcaatgaaggtgtaaaaccctacagaatgacaaaatctcataaaaatataaaacaatgtgatctcctcattgcagggggtgcagctgttggtttaacattggcaatagcactcaaacaagctgcccctgaactgaaaattaacatcgttgacgctgcgcctcaagaagttatccccgtttccaatatacgcgcacttgcccttgctgcagcttctattcgtatgttaaaacaattacaatgttgggaacatatagccccccatgcccaacccattcattccatgatcataacagatgcatacacaaatgatcctgtcaaaccaactctcttaacctttgaaggagatattactcccaacgagccctttgctgctatggtggaacataaagagctcctcaatgctttaaaaaagcgtgcaaaagatctggatatccccttcatcactaacatgcgtattgttgatttccaccaagaagatcaacacaccactgtcactttaagcaataaagaaatttggcaaacgaagttgctaattgcggccgatggagcacattcgaaattacgcgaaaaagcaggtcttaaaaagttttctcattcttatacacaaacagcaatcatctgcacagtcgaacatgaaaaaccccatcatggtcaagcaatccaacattttttacctgctggacccttcgctcttctccctctcaaaggcaaccgatcagctattgtatggaatgaagaccataaaactgcgcaatattaccttaaagccgatgctcttatttttgaaacagaaatcgaaaaacgcattggtcaccgatatggaaaactctcttggaatggtgaacgccaaggctttcccttgaacctttctttaacacgccaatgtattaaaccgcgctttgctttgattggtgatgcagcgcacacaatccacccccttgccggacaaggtctcaatttaggcttacgcgatagtgctgcacttgccgaagttatcattgaaacagcacgattgggtcttgatattggctcccttactgctttagagcgctatcaaagctggagacgttttgaaattgtccgcatggccttgagcaatgactggcttaataaactcttttctaatgataatcttctcttacgaacgctccgggatgtcggccttggaattgtcaatcaaacaccaaaggtaaaaaaatattttattcaggaagctgccggcctcacccctcatgctccacgtctgctacacggtctccccctctaa

SEQ ID NO: 52 - protein, 426 aa, Bartonella henselae
MYSDLNEGVKPYRMTKSHKNIKQCDLLIAGGAAVGLTLAIALKQAAPELKINIVDAAPQEVIPVSNIRALALAAASIRMLKQLQCWEHIAPHAQPIHSMIITDAYTNDPVKPTLLTFEGDITPNEPFAAMVEHKELLNALKKRAKDLDIPFITNMRIVDFHQEDQHTTVTLSNKEIWQTKLLIAADGAHSKLREKAGLKKFSHSYTQTAIICTVEHEKPHHGQAIQHFLPAGPFALLPLKGNRSAIVWNEDHKTAQYYLKADALIFETEIEKRIGHRYGKLSWNGERQGFPLNLSLTRQCIKPRFALIGDAAHTIHPLAGQGLNLGLRDSAALAEVIIETARLGLDIGSLTALERYQSWRRFEIVRMALSNDWLNKLFSNDNLLLRTLRDVGLGIVNQTPKVKKYFIQEAAGLTPHAPRLLHGLPL

SEQ ID NO: 53 - DNA, 1398 bp, Yarrowia lipolytica
  CDS (1)..(1398)
atgcttcgatccacgaccttgcaacggctgcggccggctgtttttcgagtccagcgatggaactccaccaccacatctgctcccaaaccctccaccacccactcggacattgtggtggttggaggaggtcctgccggcttgaccattgccgctgccctcaaacactaccctgagacggtcaacaagtctgtgactcttgttgagtttgggtctctggacaatctgaagacctggggccccgatatggagcggtttgagaaccgagtcagttctctgaccccctcttcggtcgagtatctgaccaagatcggcgtgtgggaacatgtcaaccgagaccgagttcaggcctacagacacatgacagcgtgggatggagtgtcgggctctaaggtgcagttcaacaccacccaattgatgggcgagggccgagatatcgcctacatgaccgaaaacttcaacctgcagaacggcttgctcaagcagctggcaaataagcccaatctgacgatcctggacaagaccaaggtggagggcgttgagcgaacacccgaatcgcacaacaagccccttgtcaagctctccaatggttctactatctctactgatctgctgatcggtgctgatggagccaactctcctgttcgaaccttttccggtatcgaggcacgaggatgggactacaacacccacggtctggttgccaccgtgcgtctggccaacgagcagcagtcggcatggcagcgattcctccccaccggtcccattgctcttcttcctctgcctaacagattcggctcgctcgtctggtccaccacccccaagatggccgcccagctcaagcagctgactcccgagcagtttgtcatgatggttaactgtgcattcaacctcgagcccaccgacattgagtacctggttgaacatcccgatgaaatcatgactgacgctccttacagactgtctcagcgatcttctaaccccgacgtgccctgccccattgttgctgtccaagacaagtcgcgagcctccttccctcttaagatgaagcatgccgacacttatattgccgagaacgtggctctggttggagatgctgcccacaccacccatcctctagcaggacagggtctcaacatgggccagggagacgcccagagtctggccattgccattcgaaacgctgcggggcgtggagccgatattggatccaccctgaccctggagccctactgggccgaccagtactttaagaaccacaagctgctgggcgtggtcgacaagctgcacaagttgtactcgacccgaaacccgctggtggttggtctgcggtcgttgggtcttgatgcggtcaatagtgtcaagcccgtgaaggatttcttgatgtctcaggcgtcgtaa

SEQ ID NO: 54 - protein, 465 aa, Yarrowia lipolytica
MLRSTTLQRLRPAVFRVQRWNSTTTSAPKPSTTHSDIVVVGGGPAGLTIAAALKHYPETVNKSVTLVEFGSLDNLKTWGPDMERFENRVSSLTPSSVEYLTKIGVWEHVNRDRVQAYRHMTAWDGVSGSKVQFNTTQLMGEGRDIAYMTENFNLQNGLLKQLANKPNLTILDKTKVEGVERTPESHNKPLVKLSNGSTISTDLLIGADGANSPVRTFSGIEARGWDYNTHGLVATVRLANEQQSAWQRFLPTGPIALLPLPNRFGSLVWSTTPKMAAQLKQLTPEQFVMMVNCAFNLEPTDIEYLVEHPDEIMTDAPYRLSQRSSNPDVPCPIVAVQDKSRASFPLKMKHADTYIAENVALVGDAAHTTHPLAGQGLNMGQGDAQSLAIAIRNAAGRGADIGSTLTLEPYWADQYFKNHKLLGVVDKLHKLYSTRNPLVVGLRSLGLDAVNSVKPVKDFLMSQAS

SEQ ID NO: 55 - DNA, 1209 bp, Photobacterium profundum
  CDS (1)..(1209)
atgaatgtgaagcagtatgatgtagtgattgctggtggggcaatggcgggggcgacacttgccattgcactgaacaagcttattagcgaacgagacgttaaacgtcaattacgtgtcgctgtggttgaggctgttgcgccgaatgtagaccaacatccgggatatgatgcgcgcagtattgcggtgtcattcggctcgagccgcttactgagtaaagttggtatttggtcgatgctgtcgtcggttgctacgcctatcgctcacattcacgtttctgatcgtggtcatgccggtattgttcgactagatgcagaagagcaagcgattgatgctctgggttatgttattgaattagcagatgctggaaggttatttcaccaacagttaaatgatttagataacgtagcgctatattgccctgattcgatcattgatatttcacgtactcagcaaaatgttacgctttgtctggattccggcgagcagatccaaacgcaattgttagtgactgctgatggcgcactctcgagttgctgtgagctattaggaataggacggcatgagcatgactttgaacaagtcgcaattattgccaacattaccacagcacaagcacaccaaggtcgggcttttgagcgttttacgccgtatggtcccgtggcgttattgccgatgtcggaagggcggagctcattggtgtggtgcattaaacctgagtaccaatcaacggtgatgagctgggatgacgctcgctttttagctgaattgcaaagcacctttggttggcgtttgggggaattagtgaaaacaggtaagcgtgttgcttacccgttattacttcgtcagtctgaagcgttaacgtctcaccgtgtggctgtggtgggtaatgccgcacagacattacatccgattgcagggcaaggctttaatttaggtctgcgtgatgttatgacattagctgaagaagtggtgaatagcttcgaacgcaacgaagatgttggtgaggcggcattattaagccgttatcgacagcgtcggctgcctgatcgtcaagcaactgtgttgatgacggctgggttagtgagtgtgtttgcgaatgatagttttcctcttgttgctggtcgaaacacggggcttatggctatgaatatttttgatacgttaaaagcaccgctgttaaggcgtgcaatgggacaggtagagcgatga

SEQ ID NO: 56 - protein, 402 aa, Photobacterium profundum
MNVKQYDVVIAGGAMAGATLAIALNKLISERDVKRQLRVAVVEAVAPNVDQHPGYDARSIAVSFGSSRLLSKVGIWSMLSSVATPIAHIHVSDRGHAGIVRLDAEEQAIDALGYVIELADAGRLFHQQLNDLDNVALYCPDSIIDISRTQQNVTLCLDSGEQIQTQLLVTADGALSSCCELLGIGRHEHDFEQVAIIANITTAQAHQGRAFERFTPYGPVALLPMSEGRSSLVWCIKPEYQSTVMSWDDARFLAELQSTFGWRLGELVKTGKRVAYPLLLRQSEALTSHRVAVVGNAAQTLHPIAGQGFNLGLRDVMTLAEEVVNSFERNEDVGEAALLSRYRQRRLPDRQATVLMTAGLVSVFANDSFPLVAGRNTGLMAMNIFDTLKAPLLRRAMGQVER

SEQ ID NO: 57 - DNA, 1209 bp, Photobacterium profundum
  CDS (1)..(1209)
atgatgcagagtgttgatgttgccattattggtggtggtatggtgggtttaactcttgcagctgcattagctgaaacggaattgcgtgttgctgttattgaaggacaattacctgatcctgaattggctttattgccggatgtacgtgtgtcagccttaagccgtgcgagtgagcgtattttacgacgagtaggggcttggcaaggtattgagtctcgccgattcagtccatataaccgaatggaagtatgggagcaagatagctttgccaagattcaatttgatgccgaaaggttatcacaacctgatttaggtcatatcgttgaaaaccgcgttattcaacttgcattactcgatcgcattaagcagcttaataatgtgaccttaatggccccagagcgatgccaaaacattgcttttggtgaaagcgaagcatggttaacgatggagtcgggcaagagcttaacggcaaaattagtggtgggtgctgatggcgcgaactcatgggtgcgtcgtcaattagatatcccattaacgcattgggattatgggcacagtgccattgttgccaatattcgctgtgctgaaccccatgataaaacagcccgccaaattttccgtccgcaaggaccattagctttcttaccgcttgctgaaagcgatttgtgttctatcgtatggtcggtagcaccagatgaagcagaacagctgtgtgggttgtctgatagcgaatttaataaatcactgacagcggcatttgataaccgtttaggcttatgtaaggttgaagggcagcgtcaagcattcccattaaagatgcgatatgcccgtgattttgtgcgtgaacgtgttgcattagtcggcgatgctgctcatacgatccaccccttagcgggtcagggagttaaccttggtttgttagatgccgcgagcctagcgcaagagctaaaagcgttatggcagaaagaacaagatattggtcagaagagcaatctgcgtcattatgagcgttggcgtaaagcagaagccgcgaagatgatcactaccatgcagggcttccgtgatttatttgacggcagtaatccggctaagaaactagtgcgtgatttaggcatgttatttgccgataaagcgccgggtgtgaaagatgaatttatgcgccgtgctttaggcttatcgggtgaattaccggatcttgctaaacgctaa

SEQ ID NO: 58 - protein, 402 aa, Photobacterium profundum
MMQSVDVAIIGGGMVGLTLAAALAETELRVAVIEGQLPDPELALLPDVRVSALSRASERILRRVGAWQGIESRRFSPYNRMEVWEQDSFAKIQFDAERLSQPDLGHIVENRVIQLALLDRIKQLNNVTLMAPERCQNIAFGESEAWLTMESGKSLTAKLVVGADGANSWVRRQLDIPLTHWDYGHSAIVANIRCAEPHDKTARQIFRPQGPLAFLPLAESDLCSIVWSVAPDEAEQLCGLSDSEFNKSLTAAFDNRLGLCKVEGQRQAFPLKMRYARDFVRERVALVGDAAHTIHPLAGQGVNLGLLDAASLAQELKALWQKEQDIGQKSNLRHYERWRKAEAAKMITTMQGFRDLFDGSNPAKKLVRDLGMLFADKAPGVKDEFMRRALGLSGELPDLAKR

SEQ ID NO: 59 - DNA, 1197 bp, Rhodopseudomonas palustris
  CDS (1)..(1197)
atgacccagagcctgatcgagcctaacagctacgacgccatcgttgtcggcggcggccccgccggcctgaccgccgccatcgcgcttgccgaaaccggcgccgtcaccgcattgatcgcgcgacaagtgccctacggcgataatcgcactacggccctgctcggcgattcgatcgacattctcgaccggctcgacgtctggcgccgctgctcgagcaaggccgccgcgctgcgatcgatgcgactggtggacgacaccggccggttgatccgggcgccagaagtgaagttcgcgtccgatgaaatcggcatggacgcgttcggctacaacatcgagaaccgtgccctgctggtcggcctcgaagaacgcgcggccgagctgtcgaacctgcagcgtttcgacgatgaagctgaatcagttgtgccgggcgacgacgaagtgatcgtgcggatgcgcggcggccggaccgtctcggccaagctggtggtcggcgccgacggccggcagtcccaatgccgcgaggccgccggcatcaaggtgagtagccgcgccctgcaccagtcggcgctgaccttcaatgtcaagaccacccgctcccacgacaacatctcgaccgaatttcacaccaaggaaggcccgtgcgtgttcgtgccgctgccgggtcggcggatgagcatcgtctgggtcgcggcgccgaaggaagcgcagcggctgatggcgctatccgacgacgaactgtctgcagcggcggaaaagcagtcacagtcgatctacggtaggatgaccgtcgagcccggccgcaatctgtttccgctggcgatcgagaagcccgccgcttacgcacagcggcgcatcgcgttggttggtgaggccgctcacgtcgtccccccgatcggcgcgcaggggttgaatatggggctgcgggatgccggggacctcgccgagatcgtgcgcgacgcgatggcgaatggcacggacatcggctccgacgctgtgatgacgcgctatggccgtagccgcgggcccgacatcgccagccgcaccgccgcgatcgacatcgccaaccgcaccctgctcagcgatctcttgcccgcgcagatgctgcgggcgacggggatgcatctgatcagctcggtcggcccgatccgccggttcgcgatgcgcgaggggctgtcgccgttctggcgctcgatctga

SEQ ID NO: 60 - protein, 398 aa, Rhodopseudomonas palustris
MTQSLIEPNSYDAIVVGGGPAGLTAAIALAETGAVTALIARQVPYGDNRTTALLGDSIDILDRLDVWRRCSSKAAALRSMRLVDDTGRLIRAPEVKFASDEIGMDAFGYNIENRALLVGLEERAAELSNLQRFDDEAESVVPGDDEVIVRMRGGRTVSAKLVVGADGRQSQCREAAGIKVSSRALHQSALTFNVKTTRSHDNISTEFHTKEGPCVFVPLPGRRMSIVWVAAPKEAQRLMALSDDELSAAAEKQSQSIYGRMTVEPGRNLFPLAIEKPAAYAQRRIALVGEAAHVVPPIGAQGLNMGLRDAGDLAEIVRDAMANGTDIGSDAVMTRYGRSRGPDIASRTAAIDIANRTLLSDLLPAQMLRATGMHLISSVGPIRRFAMREGLSPFWRSI

SEQ ID NO: 61 - DNA, 1167 bp, uncultured bacterium 578
  CDS (1)..(1167)
atgaaagtgttcgatgtaattgtcattggtggtggcatgatcggccttgcttttgctttagagttatcacagaaaaaaaactgctcgatcgccattattgagccaaatacatgtaaccctgcaatcaatgacacgtttcattcacgagtaagtgctattacaccatcttcccatgagtacctagtctctcttaatatttggaataacattaaaagaaaaaaagcatttgtggctacaaaggtatgggatcaaaattcgcatggacatctcaattttcacgctgaggatgagggtatggatcaacttggcttcattgtcgaaaatgatttaatacagtctgcactatttgaagcaattgactccagcaagataacgattattaatgccaagctagatagtttattaaaaactgatattggctatatgttaactctagatgacgagagtaatttgtcatgcaatctagttgtcggggctgatggtcctcaatcaaaagtcagaaacttagtggctattgaggttactgagcgtgactataatcaaaaagctattattgctaatatagttagtgaaaagtcacttgaaaatactacttggcagcgctttttatcagacagtattattgctttattgccactctctgaaaataaagcgtcaattgtatggtcttgcaaaagtaatcttgcagacgagttgatggagttagatatagatgattttaatcaatctttgtctgaagtcgttgagtatcgttttggtaagcttatactggaaagcaaaagaaaagtattcccactagtcgaaagaagtgcaaaggactatactctccctagcctcgctctagttggagatgctgctcacaacatccacccactagcaggtcagggagctaatctaggtttttcagatgcaaaggaactcaatagtcaacttttagaaaatgatgataaacccttgggcgaatatttagtcttaaggaagtatgcgagagcccgtcgattagataatgagttaatggctaaaactatgacaggtttagactggatatataaggaaaataatgagccacttcgatggcttagaggttttggtatgaatcttattgacgattccccaatgattaagtctttttttcaaaaacaggctctcggtaagtctattaaatga

SEQ ID NO: 62 - protein, 388 aa, uncultured bacterium 578
MKVFDVIVIGGGMIGLAFALELSQKKNCSIAIIEPNTCNPAINDTFHSRVSAITPSSHEYLVSLNIWNNIKRKKAFVATKVWDQNSHGHLNFHAEDEGMDQLGFIVENDLIQSALFEAIDSSKITIINAKLDSLLKTDIGYMLTLDDESNLSCNLVVGADGPQSKVRNLVAIEVTERDYNQKAIIANIVSEKSLENTTWQRFLSDSIIALLPLSENKASIVWSCKSNLADELMELDIDDFNQSLSEVVEYRFGKLILESKRKVFPLVERSAKDYTLPSLALVGDAAHNIHPLAGQGANLGFSDAKELNSQLLENDDKPLGEYLVLRKYARARRLDNELMAKTMTGLDWIYKENNEPLRWLRGFGMNLIDDSPMIKSFFQKQALGKSIK

SEQ ID NO: 63 - DNA, 1182 bp, uncultured bacterium 311
  CDS (1)..(1182)
atggatgctgaagttgctttagtcggtgcgggaactgtaggttcatctttagcatgttcattggccaagcaaggaataaaagtaatattatttgatcgagacagcccactagatttatctgaaacttctaggttagaaggtaggacagtagctttaaatttatcttcaatcgatctctttgatgaactaggtatctggagtgagcttaaaaagacaggcacaccctttaaccgcatgtttgtttgggattctaagggtagttcaccccttgaattcttggcccaagagatagaaagggaagagttgggttacgttgtctccaataatttaattttagaatatcttaaaaagattattgaagattctaataatatcagtcttaagcaagaaactgagttatctgaagttaaagtaagtgataaagaagtagtaatctcttgttcgaacggtgacaagattacttcaaaattattaataggagctgatgggcttaattcaactttaagaaagattgcacaaataaaaactagatcttggagctataaccaaaaggcttttgtggcagcattaaaaaccgaaaagcctcatgatcacactgcttggcaagtatttactccaacaggtccaatagccctcctgcctttcgattctttagaaagagctaatatttctctggtatggtcagctgaacttaattactcagaaaaactttcaaatctaagtaaaaaagaatttataaaagaattggaagaaaagacagagttaattttaggaaaaatagagttgaaaacagacataagttcatttccccttaatcaattacactctaaaaattatgttgctgaaagggtagctttggtgggtgacgctgcgcattcttttcatcccctggctggccaaggattaaacttaggcttatcagatgctgctagcttagccagtaagcttataaaagctagaagaagtggagttgatatagggtctgataaaatccttgaagactatgaaagatctagaaaaattcctaatttaactatggctgcaatgatggagttgttcaaacaagggttcgaaacatcagatccctggatcaaattagccagaaatcttgcttttaaaacagcttctgaaagtcagattttaaagaaaacgttaataaaagaagcagcaggaattacttaa

SEQ ID NO: 64 - protein, 393 aa, uncultured bacterium 311
MDAEVALVGAGTVGSSLACSLAKQGIKVILFDRDSPLDLSETSRLEGRTVALNLSSIDLFDELGIWSELKKTGTPFNRMFVWDSKGSSPLEFLAQEIEREELGYVVSNNLILEYLKKIIEDSNNISLKQETELSEVKVSDKEVVISCSNGDKITSKLLIGADGLNSTLRKIAQIKTRSWSYNQKAFVAALKTEKPHDHTAWQVFTPTGPIALLPFDSLERANISLVWSAELNYSEKLSNLSKKEFIKELEEKTELILGKIELKTDISSFPLNQLHSKNYVAERVALVGDAAHSFHPLAGQGLNLGLSDAASLASKLIKARRSGVDIGSDKILEDYERSRKIPNLTMAAMMELFKQGFETSDPWIKLARNLAFKTASESQILKKTLIKEAAGIT

SEQ ID NO: 65 - DNA, 1416 bp, Ashbya gossypii
  CDS (1)..(1416)
atgttgagaagggcatacacgctcttgcaccgccggacactcgcagtatcctctgccgggatagagaagacggatgtactgattgtcgggggcgggcctgctgggctaacgttggctgccggcatcaagaactccccccatctttccgatgtcccagtaactctagtcgaaggtagctcgctaacgaagatcgctgggttctacaaatccccatctgcgaaataccataaccgaatcatcaacctaactccgcagtcgaagaacttcctggagcaaaaagtgggcgtcaagttgctggaagaccgcatacaggcgttcgacgggttctacgtgacggatggctgctcatcaggcgcgctagagatgacacgcgagaacgtgggatacatggcggaaatattcaacatccagagctcagtcctacaccgcatggagcagctgtcgcactccgggctggacttgattgagaacgccaaagtcacgtccatcgagcacagcgatcctgctgatccacagtcctggcctatagtgaccctggacaatggccggcgcatccagacgagactgctggtcggcgcagacggcaaaaactcgcccgtgcgcaggttctcaggcgtccaatcccgcggctggtcatacgggcgctggggcatcgttgcaaacctacagcttgagtaccctccgttcaagacacgcggctggcaacgtttcctccctacgggtcccattgcacacctgccaatgccgggtaccgatgcctgcctcacgtggagcacaacagaaccgctcgcccgtctactgctctctctcgaaccagccgccttcgcgaccctggtgaacgcggcgttcattctcgacgacgcggacatgcagttttactacaagcatttgcaagagggcacgctatcgaccagcgaactgatagccgatgtcgagcaccgcatccaacaagttttcagcaacctacaggacgagggcttaatagacgaaatatacccaccaaaggtcgtcgacgtttacgagggctcgcgcgcccgtttccccctcagcatggctcacgcggacacgtatgtcgcggaccggatcgcgcttgtcggcgatgcagcccactcaacgcatcctctcgcaggtcagggtctgaacatgggtcaaggagacgttgaggcgctgttgtcggcactagaaagggccaaccagcgcggactggatctcggctcgctgctcgcgctcgagccctactgggcagagcgctacccaataaacaacgccctaatcggcggtgcagataaattgcacaagctctactcaaccgattttgcgcccatcgtcgccgccaggactttcggcttgaacctcgtcgacaagcttggaccgctgaaagacctcataatggcaaaggtcagcggcccaaattaa

SEQ ID NO: 66 - protein, 471 aa, Ashbya gossypii
MLRRAYTLLHRRTLAVSSAGIEKTDVLIVGGGPAGLTLAAGIKNSPHLSDVPVTLVEGSSLTKIAGFYKSPSAKYHNRIINLTPQSKNFLEQKVGVKLLEDRIQAFDGFYVTDGCSSGALEMTRENVGYMAEIFNIQSSVLHRMEQLSHSGLDLIENAKVTSIEHSDPADPQSWPIVTLDNGRRIQTRLLVGADGKNSPVRRFSGVQSRGWSYGRWGIVANLQLEYPPFKTRGWQRFLPTGPIAHLPMPGTDACLTWSTTEPLARLLLSLEPAAFATLVNAAFILDDADMQFYYKHLQEGTLSTSELIADVEHRIQQVFSNLQDEGLIDEIYPPKVVDVYEGSRARFPLSMAHADTYVADRIALVGDAAHSTHPLAGQGLNMGQGDVEALLSALERANQRGLDLGSLLALEPYWAERYPINNALIGGADKLHKLYSTDFAPIVAARTFGLNLVDKLGPLKDLIMAKVSGPN

SEQ ID NO: 67 - DNA, 1179 bp, Shigella flexneri
  CDS (1)..(1179)
atgagcgtaatcatcgtcggtggcggcatggcgggcgcgacgctggcgctggctatttcccggttaagtcacggggcgctgccggtacatttgattgaagcgactgcgccagagtcacatgctcatccgggctttgatggacgagcgatagcgctggcggcgggtacctgtcagcaactggcgcgcatcggcgtctggcaatctctggctgattgcgcaaccgccatcactaccgtgcatgtcagcgatcgtggtcatgctggattcgtcaccctcgccgcagaagattaccaactggcggcgctggggcaggttgtcgaattgcataatgtcgggcaacggctgtttgcattgctgcgaaaagcacctggcgtaatgctgcattgccccgatcgcgtagctaacgttgcccgtactcagagtcatgttgaagtgacgctggagagcggcgagatgctgacgggccgcgtgctgatagccgctgatggcacccattcagcgttagccaccgcgtgcggcgttgattggcagcaggagccttacgaacaactggcagtgattgccaacgttgctacttctgttgcgcacgaaggccgcgcttttgaacgcttcacgcaacatggcccgctggcgatgttgccgatgtctgacggacgctgttcgctggtctggtgtcatccactggaacggcgcgaagaggtgctgtcgtggagcgacgagaagttttgccgtgaactccagtctgcctttggctggcgactggggcaaattacccacgccggtaaacgcagtgcttatccgctggcattaacccgcgccgccagaccgattacccatcgcactgtgctggtgggcaatgcggcgcaaactctgcacccgattgccgggcaagggtttaacctcggtatgcgagatgtcatgagccttgcggaaaccctgactcaggcgcatgagcgcggagaagacatcggtgattacggcatattgtgccgctatcagcagcgtcgacagagcgatcgcgaagcaaccatcggcgtcacggacagcctggtacatctttttgccaaccgttgggcaccgctggttgtcgggcgcaacatcggactgatgacgatggaattattcaccccggcacgcgatgtgctggcgcagcgcaccctcggttgggtggcgcgttga

SEQ ID NO: 68 - protein, 392 aa, Shigella flexneri
MSVIIVGGGMAGATLALAISRLSHGALPVHLIEATAPESHAHPGFDGRAIALAAGTCQQLARIGVWQSLADCATAITTVHVSDRGHAGFVTLAAEDYQLAALGQVVELHNVGQRLFALLRKAPGVMLHCPDRVANVARTQSHVEVTLESGEMLTGRVLIAADGTHSALATACGVDWQQEPYEQLAVIANVATSVAHEGRAFERFTQHGPLAMLPMSDGRCSLVWCHPLERREEVLSWSDEKFCRELQSAFGWRLGQITHAGKRSAYPLALTRAARPITHRTVLVGNAAQTLHPIAGQGFNLGMRDVMSLAETLTQAHERGEDIGDYGILCRYQQRRQSDREATIGVTDSLVHLFANRWAPLVVGRNIGLMTMELFTPARDVLAQRTLGWVAR

SEQ ID NO: 69 - DNA, 1176 bp, Vibrio vulnificus
  CDS (1)..(1176)
atgacgcaatatgatgttgtaattgctggcggagcaatggctggggcgacgctcgctttggcactttcgcacctgacggataataaattgaacgtcgcggttgtcgaaccttatcaggttgataccagtcacccggggttcgattctcgctcaatagcactctcatatggcaccgttgatattttgcgtcgtttccaactctggtcatcgatagcgccttgtgccacgccgattacggatattcacgtttctgatcgctctcatctggcaatgaccgatatttccgcgcaacaagttggcgttgacgcactgggttatgtggtggagctggcggatgttgggagcatctatcagtcgttattgcagcgttgtgactccatttccctctacacccctgccgcagtggaacgcgtggagcgattcacggatagcgttgcggtgcatttgaataatggagaaacgctgcaggcaaaactgctggtggccgctgatggggcagtctccaactgttgtcagcaactgggtatgccccttgtgcagcgtgattttgaacaaaccgctgtcattgctaatgttgtgacagaacaggcgcatcgtgggcgtgcgtttgaacgctttactgagcatggtccagtcgcgttactgccgatgtctgacaatcgcatgtctttggtgtggtgcctgcctccggatttagctgagcaggtgatgttgttatctgaagagcaatttttggcacgtttgcagcaagagtttggttggcggttaggtcaaatgcaaaaagtgggcatgagggcgagttatccgctgatattacgtcatcgagaacagaacatctctcatcgctttgctgtggtaggtaacgcggcgcaaaccttacatccgattgctggacaagggtttaatcttggtattcgcgatgtggcctcattggcagaagagatcaccaagcagcttgatgatgttggggcgtattcttctcttatgcgctttaagcagcgccgttgtggtgaccgacaaaacaccatttggatgacgaccagtttggtacaccttttctctaatgattaccttgcactcagagtggctcgcaacctcgggctagtgatgatggataatctttctgggctgaaacagccactattacgccagacattaggtctggtgagccgatag

SEQ ID NO: 70 - protein, 391 aa, Vibrio vulnificus
MTQYDVVIAGGAMAGATLALALSHLTDNKLNVAVVEPYQVDTSHPGFDSRSIALSYGTVDILRRFQLWSSIAPCATPITDIHVSDRSHLAMTDISAQQVGVDALGYVVELADVGSIYQSLLQRCDSISLYTPAAVERVERFTDSVAVHLNNGETLQAKLLVAADGAVSNCCQQLGMPLVQRDFEQTAVIANVVTEQAHRGRAFERFTEHGPVALLPMSDNRMSLVWCLPPDLAEQVMLLSEEQFLARLQQEFGWRLGQMQKVGMRASYPLILRHREQNISHRFAVVGNAAQTLHPIAGQGFNLGIRDVASLAEEITKQLDDVGAYSSLMRFKQRRCGDRQNTIWMTTSLVHLFSNDYLALRVARNLGLVMMDNLSGLKQPLLRQTLGLVSR

SEQ ID NO: 71 - DNA, 1233 bp, Vibrio vulnificus
  CDS (1)..(1233)
atgatacaaagtgtggatgtggcgatcgttggcggtggcatggtgggactggcactggccgcggcatttaaagacagtgatttgcgtgtagcagtgattgaagggcaggctccaaatctgcaaatgaatgaactgccggatgtgagagtttccgcgctcagtcgttccagcgaacatatcttaaaaaatctgggtgcttggcaatccattgtggaaaaacgagcctctccttatgtggcgatggaagtgtgggatcaagacagttttggccacattgactttagtgcggatgcgatggcacagccggatcttggccatattgttgaaaatcgcgtcattcaactggcacttttggagcaggttaacaagctggataatgtgatggtgctgatgccttgtcagtgtcaatcgatgagtgtaggagggagcgaagtgtggttgtcgctcgacaatggtcaggcgctcacggccaaattggtggttggtgctgatggcgccaattcttgggttcgacgtcagcaggatatcccgctaactcattgggattatggccattctgcgatcgtagccaatgttcgcactgtcgagccacattgctcagttgcacgtcaaatttttactcctcaaggacctttggcctttctgccaatgtctgaagagaacatgacctcgattgtgtggtcgactgaatcactgcgcgcaacgtgtttgatggcgatgtcagacagtgagttcaataaggcgctgagtgccgaatttgatatgcgtttgggactgtgcgaagtggttggggagcgttttagcgttccactgaaaatgcgttttgctcgagattttgtcaaagagcgtgtcgccctgattggtgacgcagcacacacaatccatccgttggcggggcaaggtgtgaacttgggcttgctcgacgctgccagtctggcgcaagagatcctcgcgctttggcaacgtggtgaagacattggtaccaagcgcaacctgcgtcgttttgaacgttggcgtaaagcggaagcggcgcaaatgattgccgcgatgcaaggttttcgagagttgtttgccggctctaatccgttgaaaaagttcttacgtggcgttggtttgacaatggcaggacaccttccgggtgctaaagagcaaatcatgagacgtgcgttgggattggatggcgaacttcctgagttggcgaaacgtcgtcaactagagctgattcgctcatag

SEQ ID NO: 72 - protein, 410 aa, Vibrio vulnificus
MIQSVDVAIVGGGMVGLALAAAFKDSDLRVAVIEGQAPNLQMNELPDVRVSALSRSSEHILKNLGAWQSIVEKRASPYVAMEVWDQDSFGHIDFSADAMAQPDLGHIVENRVIQLALLEQVNKLDNVMVLMPCQCQSMSVGGSEVWLSLDNGQALTAKLVVGADGANSWVRRQQDIPLTHWDYGHSAIVANVRTVEPHCSVARQIFTPQGPLAFLPMSEENMTSIVWSTESLRATCLMAMSDSEFNKALSAEFDMRLGLCEVVGERFSVPLKMRFARDFVKERVALIGDAAHTIHPLAGQGVNLGLLDAASLAQEILALWQRGEDIGTKRNLRRFERWRKAEAAQMIAAMQGFRELFAGSNPLKKFLRGVGLTMAGHLPGAKEQIMRRALGLDGELPELAKRRQLELIRS

SEQ ID NO: 73 - DNA, 1179 bp, Photorhabdus luminescens
  CDS (1)..(1179)
atgaacgtgattatcgttggtggaggcatgaccggcgcgacgcttgcgctggcgatatcttccctgagtaaggggcagatccatgtgtccctgattgaagcagcagagccggagcagaaacatcccggctttgatgccagagcgatagcgctggcttacggtacttgtcagcgtttacaacagattggtgtttggtctgctctggaagattatgtgataccaataactcacgttcatgttagtgatcgtggtcatgcagggtttgtgaatctttatgcaaaagaatataacattccagcgctaggtaatgttattgaattgtatgatgcagggcagggtttgttcggattgctgaaaaatgcgcctggtgtaacgctatattgtccatccaaggttatggctgttgaaagaactttgtcatcggttgctgtcattttggacagtggcgaacgattgcaaggtgaattgctggtagcagcagatggcagtcattctgccattggtcacgcttgtaatattcagtggcagcggcatgcttatgagcaggttgccgtgattactaatgtactgacttcagagcatccgcgaggtagggcatttgaacgtttcaccgaatatggcccacttgctttgctgccaatgtctgaggggcggagctcgctggtatggtgccatcagttggcgcggagaaaggagatagcgggttggaataatgagcaatttcttaggcagttacagcaagcatttggctggagactggggaaaatattggaaaccggccagcgttatcgctatccattgacactatctactgcaaatcaacaaattagccaccgattggcgctggtgggaaatgctgcacaaacattacatccgattgcgggtcagggctttaatcttggtatgcgagatgttatgacactggctcagattgtttctgaggcttttgctgctggtcaggatattggtgcttaccaggtcctggctaactatcaacagcaacgggttttagatcgggaaaacaccattgatattaccgatggattgatacgggtatttgccaatcgttattttccattacaaatcgggcgtaactttggcctgatgatgatggaaaaatgccctcctatgcgggatatactggcccgtcagactctaggttgggtcgcccaaagataa

SEQ ID NO: 74 - protein, 392 aa, Photorhabdus luminescens
MNVIIVGGGMTGATLALAISSLSKGQIHVSLIEAAEPEQKHPGFDARAIALAYGTCQRLQQIGVWSALEDYVIPITHVHVSDRGHAGFVNLYAKEYNIPALGNVIELYDAGQGLFGLLKNAPGVTLYCPSKVMAVERTLSSVAVILDSGERLQGELLVAADGSHSAIGHACNIQWQRHAYEQVAVITNVLTSEHPRGRAFERFTEYGPLALLPMSEGRSSLVWCHQLARRKEIAGWNNEQFLRQLQQAFGWRLGKILETGQRYRYPLTLSTANQQISHRLALVGNAAQTLHPIAGQGFNLGMRDVMTLAQIVSEAFAAGQDIGAYQVLANYQQQRVLDRENTIDITDGLIRVFANRYFPLQIGRNFGLMMMEKCPPMRDILARQTLGWVAQR

SEQ ID NO: 75 - DNA, 1221 bp, Photorhabdus luminescens
  CDS (1)..(1221)
atgcaatcatttgatgtggttatcgctggtggcggtatggttggtttagcgcttgcctgtggcttacaaggcagtggcttgcgagtggctgtggtggagagctatccgccgactcaatccgttgttgctggagaagagtacactttgcgggtttctgcgattaatgcagctagtgagcgcttattgcagcatcttggtgtgtggcaagatattttggatatgcgcaccagtccttatcaggaaattgaggtttgggagcgggatagctttggccgtattcggttcagtgcggctgaatatgggctggaatatcttggtcatatcattgaaaaccgagttatccgtgaaacattatggaaaaaagtagatagcttatctgacgtgaccattttggcacccgcggctttgaaacaggtagcttggggtgaaaatgaaacttttatgactttatccgatggtcgcatgttaactgctcgtttagttgttggtgctgatggtgctcattcatggttgcgtcaacatgctgatatccctctcacattctgggattatgaacatcatgcattggtagccactattcgcaccgaagagccgcacggctgggttgctcgtcaggtcttttatggtgagggtattttggcgtttttgccgcttgccgatccccatttatgttctatcgtctggtcactaccgggtgaagtcgcagaacagtacaaacagcttgatcataggcgtttcaaccagcaattggcggtagactttgatctgcgccttggtcaatgtgaactgatgagtgagcgtctgacgattccactgacgggtcgttatgcccgtaattttgcggctcatcgtctggccttgttgggagatgccgcccatactattcacccattggcaggccaaggtgtgaatttgggctttatggatgtcgctgagctgataggtgaattgcgtcgtttgcatggtcagggaaaagatattggtcagcacttttatttacgtcgttatgagcgccgacgtaaacatggtgctgctgtgatgctggccgggatgcaaggttttcgtcaattatttgatggcaataatccggcgaaaaaacttttgcgggatgtcgggttgtctctggcagataatttaccgggaattaaacctaaattacttcgtcaggcaatgggattgaatgacttgccgaattggctctgttcggctgaaaaaatctaa

SEQ ID NO: 76 - protein, 406 aa, Photorhabdus luminescens
MQSFDVVIAGGGMVGLALACGLQGSGLRVAVVESYPPTQSVVAGEEYTLRVSAINAASERLLQHLGVWQDILDMRTSPYQEIEVWERDSFGRIRFSAAEYGLEYLGHIIENRVIRETLWKKVDSLSDVTILAPAALKQVAWGENETFMTLSDGRMLTARLVVGADGAHSWLRQHADIPLTFWDYEHHALVATIRTEEPHGWVARQVFYGEGILAFLPLADPHLCSIVWSLPGEVAEQYKQLDHRRFNQQLAVDFDLRLGQCELMSERLTIPLTGRYARNFAAHRLALLGDAAHTIHPLAGQGVNLGFMDVAELIGELRRLHGQGKDIGQHFYLRRYERRRKHGAAVMLAGMQGFRQLFDGNNPAKKLLRDVGLSLADNLPGIKPKLLRQAMGLNDLPNWLCSAEKI

SEQ ID NO: 77 - DNA, 1170 bp, Chromobacterium violaceum
  CDS (1)..(1170)
atggattctacgatgagtgaacatgccgatgtgctgatcgtcggcggcggcccggtgggcgcgctggccgccttgaggctggcgcggcagggccgcagcgtgctgctgctggaggcgcgcgcgaaagacgccgaggtgcgcgacgcccgcgcgctggcgttgtcctggcatagccgccgcctgctggaagaggccggcgcctggccggccgacctgccggccacggcgatagacaccgtccacgtgtcgcagcagggcggttgcggccgcacccggctggacagcgcggacctgggtctgccgcacctgggcgcggtggtcgattacccggccttggtcgctggcctgggcggcgcgctggaggcggcgggcgtgcaggtgatatggcaatgccgggtgacggcggtgaagagtctgagccagtacgcatgcgccgaggtggaaacgccgcagggcaagcagctgctgaccggcagcctgctggtattggccgagggcggcgcgctggctgagacgctgccgggcatccgccggctgacacatgattaccgtcagtgcgcgctgctggccgaggtggagaccgaactgccgccccagggcgtggcgtacgagcgcttcgcccacgccgggccgttcgcgctgctgccgcacggcgagcgctacatgctggtgtggacccgcagccaggccgatgccgagcggctggccgccgccgacgcggcggtattgcgcgacgagctgcagcaggctttcggagagcgccagggacggatattgtcgatcgggcccagggccagtttcccgctggcgctgcgccaggccaaccgggtgaccagcgggcgggtggcgctgatcggcaatgccgcccagaccatgcacccggtggcggctcagggcctgaatctgggcttgcgggatgcggtcggcctggccgacgcgctggagaacgcagccgacgccggcgacgcgcgcgcgttgaagcgctacgcggattcgcgcaagctcgacagccacgcggtggtcggcttcacccatggcttgatcaagctgttcgacggccatcacccgctgatgagccggctgcgcggcgtcggcatgacggcgctggacgcgctgccgtccttgcggcgcaaattcgccggccacctggtgttcggcgtgcggggataa

SEQ ID NO: 78 - protein, 389 aa, Chromobacterium violaceum
MDSTMSEHADVLIVGGGPVGALAALRLARQGRSVLLLEARAKDAEVRDARALALSWHSRRLLEEAGAWPADLPATAIDTVHVSQQGGCGRTRLDSADLGLPHLGAVVDYPALVAGLGGALEAAGVQVIWQCRVTAVKSLSQYACAEVETPQGKQLLTGSLLVLAEGGALAETLPGIRRLTHDYRQCALLAEVETELPPQGVAYERFAHAGPFALLPHGERYMLVWTRSQADAERLAAADAAVLRDELQQAFGERQGRILSIGPRASFPLALRQANRVTSGRVALIGNAAQTMHPVAAQGLNLGLRDAVGLADALENAADAGDARALKRYADSRKLDSHAVVGFTHGLIKLFDGHHPLMSRLRGVGMTALDALPSLRRKFAGHLVFGVRG

SEQ ID NO: 79 - DNA, 1152 bp, Chromobacterium violaceum
  CDS (1)..(1152)
atgcgttacgacaaatatcacgcggtcgtcgtcggcggcggcctggtcggggccagcctggccctggcgctggcgcgcgccggcaagcgggtggcgctgctggaggccggcgagcccgccgttgatggactggagcagggctgggacgcgcgcgtctacgcggtcagcccggccaaccggcgtttcctggatggcatgggcgcctggcccgacatggcgcggatcggcaccatcgcgtcgatggacgtgcgcggcgacgccggcgggcggatctcgttctcggcccgcgacgccgacgccgacgcgctggcctggatcgtcgagaaccgctggctgctggcctcgctgtgggcgcagctgcgcgacggcggcgcggagctgatcaccggcgcccgcgcccaggcgctggccacgacgcctggcgaagcccggctgaagctggaggatggccgcgaactggcggccgagctgctggtgggggccgacggcgccaactcctgggtaagaggtcagctgggcttgcaggccagcgtcaaaccttatggccagagcggcgtggtggccaatttctcctgcgagcagccgcatcaaggcgtggcgcggcaatggtttttcggcgacagcatcctcgcctggctgccgatggcagggaaccgaatatcgatggtctggtccactcctgatccgcagtcgctgctgcagctgtcgaacgaggaattggccgcgcgcgtggcggaggccggcgggcgccagctgggcgcgtttgcgaccctcacgccggcggcggccttccccttgcggctgatccagcccgaggcggtggtcagcgagcgggtggcgctgataggcgacgccgcccacaccgtccatccgctggccgggcagggcgtcaacctgggtttccaggacgcggcccaactggccgcgctgctgggcgccgcgcccgattgcggcgactggatgctgctgcgccgctaccagcgccagcgccgcgaggcggtggccgcgatgcaactcggctgcgatggcttgtaccggttgttccatgcgaaactgcccggtctgccatggctgcgcaataccggcctgtccctgaccaactgcctgaccccgttgaaacggcagttcgccaggcaggcgattggatactga

SEQ ID NO: 80 - protein, 383 aa, Chromobacterium violaceum
MRYDKYHAVVVGGGLVGASLALALARAGKRVALLEAGEPAVDGLEQGWDARVYAVSPANRRFLDGMGAWPDMARIGTIASMDVRGDAGGRISFSARDADADALAWIVENRWLLASLWAQLRDGGAELITGARAQALATTPGEARLKLEDGRELAAELLVGADGANSWVRGQLGLQASVKPYGQSGVVANFSCEQPHQGVARQWFFGDSILAWLPMAGNRISMVWSTPDPQSLLQLSNEELAARVAEAGGRQLGAFATLTPAAAFPLRLIQPEAVVSERVALIGDAAHTVHPLAGQGVNLGFQDAAQLAALLGAAPDCGDWMLLRRYQRQRREAVAAMQLGCDGLYRLFHAKLPGLPWLRNTGLSLTNCLTPLKRQFARQAIGY

SEQ ID NO: 81 - DNA, 1182 bp, Chromobacterium violaceum
  CDS (1)..(1182)
atggaacaccgcgacatcgtcatcgtcggcggcggcatggtgggcagcgcgctgggcgcggcgctctcgggcaagggcctgtcggtctctgtgctggaacgggaagcccccgcgccgttcgcgccggaacaggcgccggacctgcgggtctcggcgatcagcccggcttccgccgcctttctgcaaaccatcggcgcctggggccaggcgctggcgatgcgcgccgcgccctatcgccgcatgcaggtctgggagcgggacgaggccgccggcacgctgttcgacgccgccgaggccggcgtgcccgaactgggccacatcgtggaaaaccgcgtggtgcagctggccgccaccgaggccttgctggccaagggcgacatcgactaccgctgcccggccgtggtgtcggacatcgtctaccgtccccaagcctcccagttgacgctgtcggacggcagcaggctgcaagccaggctgctgatcgccgccgacggcgcccgctctcaggtgcgcgacgccgccggcatcggcgtcaccggctgggactacccgatgcacgcgctggtcctgtcctgccggatcgacggcggccagcaggacatcacctggcagcgcttcacgccggacggcccgcaggccttcctgccgctaagcggcgacgcggcctccctggtgtggtaccaccggcccgaagaggtgaagcgcttgctgacgctgggcgacgacgagctgatcgccgccgtcagccaagcgtttccgcgcaagctgccgggcatccgggagctggcggcgcgcggcagcttcggcctgacccgccgccacgcccaatgctacgtcaaggacggcgtggcgctggccggcgacgccgcccacaccatccacccgctggcaggccagggcgtcaacctgggcttccaggacgcagcgatgctggcccggaccattctggacgcccatgccaagggagaggattgggcgagcgggaagacgctggtgcgctatcagcgcgcgcgcaagcccgccaacctggcgatgcaggccggcatggacgccttctgctacggctttgccaacgatatcggcccgctgcgcctgctgcgcggcctgggcttgcggctggcagacaaggccgggccgctgaagcgcgaggcgatacgctacgcgctggggctgcgcgcctga

SEQ ID NO: 82 - protein, 393 aa, Chromobacterium violaceum
MEHRDIVIVGGGMVGSALGAALSGKGLSVSVLEREAPAPFAPEQAPDLRVSAISPASAAFLQTIGAWGQALAMRAAPYRRMQVWERDEAAGTLFDAAEAGVPELGHIVENRVVQLAATEALLAKGDIDYRCPAVVSDIVYRPQASQLTLSDGSRLQARLLIAADGARSQVRDAAGIGVTGWDYPMHALVLSCRIDGGQQDITWQRFTPDGPQAFLPLSGDAASLVWYHRPEEVKRLLTLGDDELIAAVSQAFPRKLPGIRELAARGSFGLTRRHAQCYVKDGVALAGDAAHTIHPLAGQGVNLGFQDAAMLARTILDAHAKGEDWASGKTLVRYQRARKPANLAMQAGMDAFCYGFANDIGPLRLLRGLGLRLADKAGPLKREAIRYALGLRA

SEQ ID NO: 83 - DNA, 1473 bp, Neurospora crassa
  CDS (1)..(1473)
atggaagcagtagcaaggagaaaagcagctgcctatgtctgcttgagttgtacccggcaattccaacgacacattcgacgacaataccacaacgccgccccacgacctgatatctacgatgtcgtgtgtgttggtggaggaccggcaggtctgagtctcttgactgccctgcgcgccaaccctgtcacctcccacctccgtgttgccctagtcgaagcccaggatctatccaaagtcaagtcatggaagctaccgccaagcaagtactcgaaccgatgcagctccctcacgcccacatccgctttctatctcgaccagattggtgcctgggaacatctcgatcaaaccagagtccaaccgtaccacgaaatgcaagtctgggatggcgttacggatgcccggatcgaatttgactgggcacccggttcggccctggtagaaggaaccaccatcgcttacatgaacgaaaacctcaacctcacatccggtctactgaagcgactggagcaactgggtggtgtatcggtattcgagggtgctaaagttgagaacatcacctttggcgaggagacggaggacctggatcttaggcaatggcctgtcgtacacatttctggaggcaagcagcttactgcccgccttttggttggagccgacggagcaaacagcccagtccgtgccttcgcgggtatcgatgcgaagggttgggattacaacagacacggcgtggtggccacgctagagatggagggcgagggttggggcggagagcacaccaagattgcctaccagaggttccttcccaccggtcctgtggctatgctgcccatgcctggaaagtattcgacacttgtctggtccacaaccccggagaatgcctcaatactcaagagcctctcgcccaaggattttgtggctatggtcaacgcagcattccgtcttagtccagtggatctggccttcatgcacacacaaggggcgaaccaagactatgagtattcgtggaggttacaacacacatccttcaacccgcgggcaatcccgcagaccgtagttggagttcaggaaggcacgattgcctctttcccattaaaaatgcgccacgctgatacctatattggagagcgtgtcgctttggtaggcgatgccgctcacaccattcatccactggcaggccagggcttgaaccagggccagggcgatgtgcagagcttggccaagacgatcgagcacgccgtcacccatggacaggatattggaagtatcatgtcactcgagtcgtacgtatcggaacgatacacagcaaaccatgtgcttcttggggtcgttgataagctccataagctctattctgccgaaagcggcccgttagtgcccttgaggtcactgggcttgaacgcagtcaatgctcttgggccgttgaagagcttcttcatgaagcaggctgcaggaagcggcaccaagctcttctga

SEQ ID NO: 84 - protein, 490 aa, Neurospora crassa
MEAVARRKAAAYVCLSCTRQFQRHIRRQYHNAAPRPDIYDVVCVGGGPAGLSLLTALRANPVTSHLRVALVEAQDLSKVKSWKLPPSKYSNRCSSLTPTSAFYLDQIGAWEHLDQTRVQPYHEMQVWDGVTDARIEFDWAPGSALVEGTTIAYMNENLNLTSGLLKRLEQLGGVSVFEGAKVENITFGEETEDLDLRQWPVVHISGGKQLTARLLVGADGANSPVRAFAGIDAKGWDYNRHGVVATLEMEGEGWGGEHTKIAYQRFLPTGPVAMLPMPGKYSTLVWSTTPENASILKSLSPKDFVAMVNAAFRLSPVDLAFMHTQGANQDYEYSWRLQHTSFNPRAIPQTVVGVQEGTIASFPLKMRHADTYIGERVALVGDAAHTIHPLAGQGLNQGQGDVQSLAKTIEHAVTHGQDIGSIMSLESYVSERYTANHVLLGVVDKLHKLYSAESGPLVPLRSLGLNAVNALGPLKSFFMKQAAGSGTKLF

SEQ ID NO: 85 - DNA, 1206 bp, Haemophilus ducreyi
  CDS (1)..(1206)
atgataataggcatcatcaaatcagcaagagaagcaacgatgaaaaaagatgtgattattattggtggcggtatggtcggggcagcaactgctttaggattggcaaagttaggcttaaacattgcgttgattgaaaaaaaaccattacccctctttcaatcggattctgcttatgacttacgtatttctgcaattagcattgcttccgtaaatttattagcagaattaggtgtatggcaacagatccaagcaatgcgtgtttgccgttacgatagcttggaaacttgggaagttgaaggctttagcacccgctttactgcggaggaaattggtctagataccttaggttttatggtcgaaaataagctcattcaaatgagtttatggcaggcacttaacctctattccaactgccaacaaatagttggttttgccgaacttactgctgaatatcattcagctggctggacgattacggttgacgatcaaactttctctacctcattaatcattgccgcagatggcgctaactctcaagttcgccattgggcaggtatcggactaactagctggcaatatcggcaacactgtttactcgcaacggttaaaactgctttacccactcaatctgttacttggcaacaattctttccaacaggtccacgtgcttttttaccgcttgcagatcaaaatggttgtgtcgtttggtacgatgcaccacagcggattgccgaactaacacagttatcacctgaacaattagcattaaccattatgcaaaactttcctacgcgcttaggtgaaatagaagtgatacaagctggcagttttccactcactcgccaacatgcgcaacactatactcacaatggggtggtattgattggagacgcggcccacacgattaatccgttagcagggcaaggggtcaatttaggttttaaagacgtaaaagtattacttgaagtgatccgccaagcgctcgaaaaagggcaatcttttgctgatgaacaagtgttaaaacagtatcaacaacaacgcaaagcagataatttgattatgcagactagtatggacttattttacaaagcatttaaaagcgaattattccccgttaaagtgatgcgcaatctggctttaatgttggcagagaaaatcacaccactcaaaaaacaagcattgaaatatgcgattgggcttaaatag

SEQ ID NO: 86 - protein, 401 aa, Haemophilus ducreyi
MIIGIIKSAREATMKKDVIIIGGGMVGAATALGLAKLGLNIALIEKKPLPLFQSDSAYDLRISAISIASVNLLAELGVWQQIQAMRVCRYDSLETWEVEGFSTRFTAEEIGLDTLGFMVENKLIQMSLWQALNLYSNCQQIVGFAELTAEYHSAGWTITVDDQTFSTSLIIAADGANSQVRHWAGIGLTSWQYRQHCLLATVKTALPTQSVTWQQFFPTGPRAFLPLADQNGCVVWYDAPQRIAELTQLSPEQLALTIMQNFPTRLGEIEVIQAGSFPLTRQHAQHYTHNGVVLIGDAAHTINPLAGQGVNLGFKDVKVLLEVIRQALEKGQSFADEQVLKQYQQQRKADNLIMQTSMDLFYKAFKSELFPVKVMRNLALMLAEKITPLKKQALKYAIGLK

SEQ ID NO: 87 - DNA, 1194 bp, Candidatus Blochmannia floridanus
  CDS (1)..(1194)
atgaataaattattttgtgaagtattaatatttggagctggtattgtgggttcatctttagctttaagtttagctaaatctggaatcaaagtaattataacagataataaacaatttgatataaccatgaataatagtattttaccaaatataagagtttctgcaattaattatgcttcagtaagattttttaaaaatattaagatctggaacaatataccttctaaattttgtacatcatattgtcatttaaaggcgtgggagtggccatcagcaacgctaacttttcattctaaatctgtaggattatcagaaatgggatatattgtagaaaataatcgtttaaaattagctttgtggcaaggtatagaagatgtttctacaataacatttttttgtccatccaaattaatttctttagaatatgatggtacatattggaaatgcttgcttagtaatagtattgtaataaatagccgtttattaattggagctgatggtattgattctaagattcgtacgatattgggaattaatattacagaatggaaatataatcaatgttgtatgttaataactacaaaaactatcacacagaaatggaaaaaatgtaatgaaactatctggcaagtttttaccccacaaggtcctataggatttttacctttacatgataactggggttcattaatgtggtttggatccaatgaatacattcaaaggttacaaaaattaccacaatcagcattagaagcaaaaattaaccattgtttttataaacaattaggtaaaattaaattatgtaatacatttgtagtgcctttaattcatagatgtgctcaacgttatatagctgcaggaggagctttagtaggagatgcggcgcatactattcatccactagccggtcaaggattaaatttaggtatccgagatgttctaagtttatctaaattattatccaacagctttgattttagtcaaaatattattaatttagatagagtattattttcttatcaaagtaaccgacaatttgacattaatattatgaaatctagtatagatttcatatattttatttttcataataacttattaccacttaaaataacacgtaatattgctttcatggcaatagaacgattttcttatataaaaagaaaaattttacaatatgctatgggagtatag

SEQ ID NO: 88 - protein, 397 aa, Candidatus Blochmannia floridanus
MNKLFCEVLIFGAGIVGSSLALSLAKSGIKVIITDNKQFDITMNNSILPNIRVSAINYASVRFFKNIKIWNNIPSKFCTSYCHLKAWEWPSATLTFHSKSVGLSEMGYIVENNRLKLALWQGIEDVSTITFFCPSKLISLEYDGTYWKCLLSNSIVINSRLLIGADGIDSKIRTILGINITEWKYNQCCMLITTKTITQKWKKCNETIWQVFTPQGPIGFLPLHDNWGSLMWFGSNEYIQRLQKLPQSALEAKINHCFYKQLGKIKLCNTFVVPLIHRCAQRYIAAGGALVGDAAHTIHPLAGQGLNLGIRDVLSLSKLLSNSFDFSQNIINLDRVLFSYQSNRQFDINIMKSSIDFIYFIFHNNLLPLKITRNIAFMAIERFSYIKRKILQYAMGV

SEQ ID NO: 89 - DNA, 1278 bp, Bartonella tribocorum
  CDS (1)..(1278)
atgtattctgatcaccataaagatgtaaaacccaataaaaaaataaaatctcataaaatcaagcagtgtgaccttctcattgcagggggagcggctgtcggtttaacactcgcaatagcactcaagcaaacagcccctaatctgaaaataaatatcgttgatgctgctccacaaggagatattcctgcttctaatatacgaacaatcgcccttgctgctgctgctgttcgtatgttaaaacaattgcaatgttgggaacctatacaaccctatgcacaacccattcactctatgatcatcacagatacaagcataagtgatcctgtcaaaccaactcttttaacctttgaaggcgacattacccccggtgaaccctttgcaactatggtagaacatagagaactcatcaacactttaaaaaaacgtgtcaaagatcttgatatccctgttatggcaaacacacgtgtcattgattttcatcaagacaaccaatacatagctaccactttaaataatgaagagatttggcaaacaaaattgctcattgcagccgacggagcccattcaaaattacgccaaaaagcaggtcttaaaaacttttctcatgcctataaacaaacagcaatcatctgcacagttgaacatgaaaaaccccatcatggtcaagcaattcaacattttttacccgctggccctttcgctcttctccctctcaaaggcaaccgatccgccattgtatggaatgaagaccataaaactgcgcaatattaccttaaagctgatgcactgatttttgaaacagaactcgaaagacgcattggtcatcgattaggaaaactctcttggaatggtgaacgtcaagcttttcccctaaacctttctttaacacgtcaatgtattaaaccccgttttgccctcattggagatgctgcccataccatccaccccattgcaggacaaggactcaatttaggattacgtgatagcgctgctctcgctgaagtgattattgaaacagcacgattaggtcttgacattggctccctcaccgctttagagcgctatcaaagctggagacgttttgaaattgtccgtatggctttaagcaatgattggcttaataaacttttttctaacgataatcttctcttacggatgcttcgcgataccggtcttggtattgtcaatcaaacgccaaaaataaaaaaatatttcattcaagaagctgctggccttaccccaaatgcgccccgtctcctaaacggcttcccgctttaa

SEQ ID NO: 90 - protein, 425 aa, Bartonella tribocorum
MYSDHHKDVKPNKKIKSHKIKQCDLLIAGGAAVGLTLAIALKQTAPNLKINIVDAAPQGDIPASNIRTIALAAAAVRMLKQLQCWEPIQPYAQPIHSMIITDTSISDPVKPTLLTFEGDITPGEPFATMVEHRELINTLKKRVKDLDIPVMANTRVIDFHQDNQYIATTLNNEEIWQTKLLIAADGAHSKLRQKAGLKNFSHAYKQTAIICTVEHEKPHHGQAIQHFLPAGPFALLPLKGNRSAIVWNEDHKTAQYYLKADALIFETELERRIGHRLGKLSWNGERQAFPLNLSLTRQCIKPRFALIGDAAHTIHPIAGQGLNLGLRDSAALAEVIIETARLGLDIGSLTALERYQSWRRFEIVRMALSNDWLNKLFSNDNLLLRMLRDTGLGIVNQTPKIKKYFIQEAAGLTPNAPRLLNGFPL

SEQ ID NO: 91 - DNA, 1167 bp, Nitrosomonas europaea
  CDS (1)..(1167)
atgaaattcgatattgtagtgatcggaggtgggctggcaggagccagtctgctggctgctctcaaaggtagcgggctcagactggcgctgatcgagtcacggccgcctgcgccattgcccgacgatgatagctgggatgcacgggtgtatgcgatcagcccaggcagtgtggagttcttgcagtcctccggtatctggcaacgaatgaatgcagcgcgtattacgcctgtccatgaaatgcgggtgcatggagacgataatgcggccagaatcgatttcagcgcttatgaaagtggtgtgccggaactggcctgtatcatcgagaatcggcagttgcagcatgccgtttgggaagaattggctggtgcggaaaatgtacagattttttgtcccgcacagtgtgactcacttgcctggcaagattctcatgtcgaactgactttggcagatggcacggttttgcagacagctttgctgatcggtgcagatggtatcaattcccgggtgcgtgagcaggcaggaatcggggttgaccgtcatagttattatcagacgggcgtggttgccaatttcgagacggagcgggtgcatcatcacattgcgtatcagtggtttcgccgtgatggcattctcgcacttctgccattgccggggaaacgagtttccatggtctggtcggcgaatacggcacttgcagatgaactgctcaatctgtccgccgaggcgttatgcgaccgggttgcccgggcagcggagtatgagctggggagcatgcggctcgttaccgcgccactcgggtttccgttgaacttcgtacatgccagatcactcattaaaccaagactggccttgatcggtgatgcggcgcatggcattcacccgcttgccggccagggagtgaatctcggattgcgcgatgttcgtgaactggctcgcctgcagcggcagtttggtggaataggggactgtggtgaattttctttgctgcgttgttatgagcgcaatcgcaaggaggatattctcgccatgggatgggtgacggatggactgcagaaactatttggcagtgaggatgcagcaatcatgcgcatcaggaatgtggggctcgggattaccaaccgtctgccacttctgaaaaacaggttgatgcgccatgcgctgagctga

SEQ ID NO: 92 - protein, 388 aa, Nitrosomonas europaea
MKFDIVVIGGGLAGASLLAALKGSGLRLALIESRPPAPLPDDDSWDARVYAISPGSVEFLQSSGIWQRMNAARITPVHEMRVHGDDNAARIDFSAYESGVPELACIIENRQLQHAVWEELAGAENVQIFCPAQCDSLAWQDSHVELTLADGTVLQTALLIGADGINSRVREQAGIGVDRHSYYQTGVVANFETERVHHHIAYQWFRRDGILALLPLPGKRVSMVWSANTALADELLNLSAEALCDRVARAAEYELGSMRLVTAPLGFPLNFVHARSLIKPRLALIGDAAHGIHPLAGQGVNLGLRDVRELARLQRQFGGIGDCGEFSLLRCYERNRKEDILAMGWVTDGLQKLFGSEDAAIMRIRNVGLGITNRLPLLKNRLMRHALS

SEQ ID NO: 93 - DNA, 1236 bp, Coxiella burnetii
  CDS (1)..(1236)
atgcgatctgagttaaagaaaaaaccgatagccattgttggcgccggcatggtgggattattattggcaaggctattagcaaaagccaaaataaataccgtcattgtcgaggcaaaaaaaccgttattacgttggaataaagaaactttagattcgcgcgtgagcgctattaatgctgtttcaacacggttgttaaaaacggcagacgtttggcaagacattcggaaaccgacttattcgcctttggttaaattaaaagtttgggatggtcttgggggcgctaaaattacttttgatagtgccgaagtgggcgcttgcgcgttaggcgctatcgttgagaatcgtgaaataattcgcgcgttatggcaaaaatgccaagaggatcctttcgtcgaatttatttgtccggcaaaaccgaaacaattgtttcatacgatggatttcgtcgagcttgaattagataacgatcgaaaaattcaaacgccgtgcgtggtaggtgccgacggggggcattcttggttgcgtcaacacatgtccattgaaattaatgagcggccttacgaacaaagcgcagtagtgacggtggtcaaaactgaaaatgcacatcagcaaacgggttggcaagtttttttaccgaaggctgttttagcgttgttacctttggctgatccacaccattgcgccattgtttggtcggtggctacggaaaaagccaatcatttaatggcgttggatgaaactgaatttaacgaagaattaaataatgcgtttggattgcgattaggaagaattcaacgactcactgagcctaaagccattcccctcattatgcgtcatgccaaaaaatacatcggttcacgcatggcattaattggtgatgccgcgcatacgattcatccgttagcgggacaaggcgttaatttaggctttatggatggcgcttgtttagctcaatgttttatcgacgcccatcaaaaaaaccaggatcttggcaacttacgcacattgcgccgttatgagcgttggcgaaaaggcgataatacaataatgctagccgccatgcgtctttttaaagaatgtttcggtgctcagtttccatttatggtacaagcgcgcaatatcggattaaatattacggatcgccttaacccagttaaaaattgttttatgaaaattgcaatgggtgaagtgagcgaattacccaatttaattaaccacatgccgttatttgcttaa

SEQ ID NO: 94 - protein, 411 aa, Coxiella burnetii
MRSELKKKPIAIVGAGMVGLLLARLLAKAKINTVIVEAKKPLLRWNKETLDSRVSAINAVSTRLLKTADVWQDIRKPTYSPLVKLKVWDGLGGAKITFDSAEVGACALGAIVENREIIRALWQKCQEDPFVEFICPAKPKQLFHTMDFVELELDNDRKIQTPCVVGADGGHSWLRQHMSIEINERPYEQSAVVTVVKTENAHQQTGWQVFLPKAVLALLPLADPHHCAIVWSVATEKANHLMALDETEFNEELNNAFGLRLGRIQRLTEPKAIPLIMRHAKKYIGSRMALIGDAAHTIHPLAGQGVNLGFMDGACLAQCFIDAHQKNQDLGNLRTLRRYERWRKGDNTIMLAAMRLFKECFGAQFPFMVQARNIGLNITDRLNPVKNCFMKIAMGEVSELPNLINHMPLFA

SEQ ID NO: 95 - DNA, 1182 bp, Shigella flexneri
  CDS (1)..(1182)
atgaccatgacaaatcaaccaacggaaattgccattgtcggcggaggaatggtcggcggcgcactggcgctggggctggcacagcacggattttcggtaacggtgatcgagcacgcagaacctgcaccgtttgtcgctgacagccaaccggacgtgcggatctcggcgatcagcgcggcttcggtatcattgcttaaagggttaggggtctgggatgcagtacaggctatgcgttgccatccttaccgcagactggaaacctgggagtgggaaacggcacatgtggtatttgacgcagccgaattaaagttgccgttgcttggctacatggtggaaaacacagtcctgcaacaggcgttgtggcaggcgctggaagcgcatccgaaagtaacgttacgtgtgccaacctcgctgattgcattacatcgagataatgatcttcaggagctggaactgaagggcggtgaaacgatccgcgcgaaactggtgattggtgccgacggcgcaaattctcaggtgcggcagatggcgggaattggcgttcatgcctggcagtatgcgcagtcgtgcatgttgattagcgtacagtgtgagaacgatcccggcgacagcacctggcagcaatttaccccggacggaccgcgtgcgtttctgccgttgtttgataactgggcatcgctggtgtggtatgactctccgacgcgtattcgccagttgcagaatatgaatatggcgcaactccaggcggaaatcgcgaagcatttcccgtcgcgtctgggttacgttacaccgcttgccgctggtgcgtttccgctgacgcgccgacatgcgttgcagtatgtgcagccggggcttgcgctggtgggcgatgccgcgcataccatccatccgctggcggggcagggggtgaatcttggttatcgtgatgtcgatgccctgattgatgttctggtgaatgcccgcagctacggtgaagcgtgggccagttatcctgtcctcaagcgttaccagatgcggcgcatggcggataacttcattatgcaaagtggtatggatctgttttatgccggattcagtaataatctgccgccgctgcgttttgtgcgtaatctcgggttaatggcggcagagcgtgctggcgtgttgaaacgtcaggcgctgaaatatgcgttagggttgtag

SEQ ID NO: 96 - protein, 393 aa, Shigella flexneri
MTMTNQPTEIAIVGGGMVGGALALGLAQHGFSVTVIEHAEPAPFVADSQPDVRISAISAASVSLLKGLGVWDAVQAMRCHPYRRLETWEWETAHVVFDAAELKLPLLGYMVENTVLQQALWQALEAHPKVTLRVPTSLIALHRDNDLQELELKGGETIRAKLVIGADGANSQVRQMAGIGVHAWQYAQSCMLISVQCENDPGDSTWQQFTPDGPRAFLPLFDNWASLVWYDSPTRIRQLQNMNMAQLQAEIAKHFPSRLGYVTPLAAGAFPLTRRHALQYVQPGLALVGDAAHTIHPLAGQGVNLGYRDVDALIDVLVNARSYGEAWASYPVLKRYQMRRMADNFIMQSGMDLFYAGFSNNLPPLRFVRNLGLMAAERAGVLKRQALKYALGL

SEQ ID NO: 97 - DNA, 1551 bp, Oryza sativa
  CDS (1)..(1551)
atgctctccagaggaagatgtttcccggcggcgagtcggatccggccgctggtcagggccttctgcgacgtgccgccttcgctccaggatgcggccgccggggtgcccagctcgcaggatcacacagagaaggttgatgatgtgaaagctagacccgacgagctcgacattgctatcgttggtggaggcatggtgggattggctgttgcttgtgcattgtccaatatgccattgactaaacatctgagggttggcatcattgatagcaatcctgcattgaagtcaagaaattatctgaagaaagatggtgtacctgattcaagggtcagtactattactcccgcgaccatatccttcttcagagatattggtgcatgggatcatgttcaacagcaaagacacgctttctttggtaaaatgcaggtatgggattacactggactgggttacacaaggtatagtgcaagggatgtgggaaaagaatatctcggatgcgtggtggagaacaaggtgctttgcaactcactgttgttacgattacaggaggaaaatggagacattgaaaagatgatctaccctactagactgatttctcttgctttgccatcaaagagcagacaagcaccaacaagggaagcaatatccagtggttaccctccagaagaattaaatcgcagcaatttagttaaacttgagctaagtgatggacaaactttatattcaaaactagtggtgggagctgacggttccaagtccaatgtaaggcaaacagcaggcataaaaacaacagggtggaattatcctcaaagtgcaattatttgtacagtggagcatattaccgaaaacgattgtgcatggcagaggtttctcccttctgggccaattgctctacttccaataggtgacaactacagcaatattgtgtggacaatgagcccagaggagtcattgcgccataagtcaatgagtcctgaagattttgtgaagtctgtgaacaatgcattggattttggttacggtccacatccacactctggtagtcttgactattacatggaaaagttattttctgacattggaagtactgctgcatctacaaaggaatgctttgaagtacctccaaaagcaatcggggtagtctgtgagagaatggcatttccattgtcgctgaagcattcacatgattatatttcaaaaaggttagcactagtcggtgatgcagctcatacagtccatcccttagctggccaaggtgtcaacttaggttttggagatgcagctgctttagcaaaagttatcgctgaaggagtttctgtgggtgctgattttggggatatttccttgctcaaaaggtatgagaataatcgcaaagcagccaatgttgcaatggcagcgctgctagatggtttccagaagatgtactctgttgattttggacccctcaatgtgcttagggctgcagcgtttcacggtgcccagtacatatcaccactgaagaagaacataatctcgtatgcaatgggcgacgcgaaatggccgctgttttcatag

SEQ ID NO: 98 - protein, 516 aa, Oryza sativa
MLSRGRCFPAASRIRPLVRAFCDVPPSLQDAAAGVPSSQDHTEKVDDVKARPDELDIAIVGGGMVGLAVACALSNMPLTKHLRVGIIDSNPALKSRNYLKKDGVPDSRVSTITPATISFFRDIGAWDHVQQQRHAFFGKMQVWDYTGLGYTRYSARDVGKEYLGCVVENKVLCNSLLLRLQEENGDIEKMIYPTRLISLALPSKSRQAPTREAISSGYPPEELNRSNLVKLELSDGQTLYSKLVVGADGSKSNVRQTAGIKTTGWNYPQSAIICTVEHITENDCAWQRFLPSGPIALLPIGDNYSNIVWTMSPEESLRHKSMSPEDFVKSVNNALDFGYGPHPHSGSLDYYMEKLFSDIGSTAASTKECFEVPPKAIGVVCERMAFPLSLKHSHDYISKRLALVGDAAHTVHPLAGQGVNLGFGDAAALAKVIAEGVSVGADFGDISLLKRYENNRKAANVAMAALLDGFQKMYSVDFGPLNVLRAAAFHGAQYISPLKKNIISYAMGDAKWPLFS

SEQ ID NO: 99 - DNA, 1998 bp, Neurospora crassa
  CDS (1)..(1998)
atggaccactgcgacgtcctgatagtcggagctggcccagtagggactactctagcccttgaactggctctgcaaggcgtatcattccgtatcatcgacaagagcccagcccgatcagagaaaagcagagccttaatcgttcacccccgtactctggagcttctagatcgccatggaactgttggccagctcatctctagaggtactatcacccgtggcggggtgttgaacatcaaccgaaaactggtagccagaatgaatttggatgatcttgacatcacggacacgagatatcctttgcctctgatggtctctcaagccgaaaccgagcagttcctggatgagtctctggccgactatggcaaggcggttgagcgggcttatactgctacgagcgtcgtccaggacgccaacggagtcaccacaactctagaaaagcccgacggcactcagaccacggttcgatccaagtacgtcgtcggttgtgacggcgcgcacagcttggtccgacattcagcgcagaaccttagctttgacggggacgcctacccacaagactttatcctctgcgacgcccgcctacgcaactccagcgttgcgcgggaccgcttcaccatttgtttcggcgacactggcctactggcattcttccctattcaatcatcccacagcgagagcaagggcgaggaaggtctcatccgcctcattgcatcaggtggccgctccgtcctcaaggactcatcaggatcaggatcagggtcccctgtggtccctgctgctgaacaacagcaacaacagcagcagcggcaacacggtgaacaaacccacgaaccccccaccctcgcgcacttccaatccctcgtggactccatcgcccctcccggctccggcaccgtccactcccccatctggctcgcccgcttccgcttacaccaccggggcgtcaactcgtaccggtccgaccgactctttgtggccggcgacgccgcgcacatccacagtcccgccggcggacagggcatgaacgtggggatccaggacgccatcaatctgggctggaagctggggacggtgctcaagtaccgggactcactgacggaggaggcaagggaggcgttgctggatagctaccacgccgagcgataccccgtggggagggcgctgcttcaggggacggataggatctttagcttcacggcagcggcgacttcgtgggtcctcaaagtgaggaatacggtgctgccgtgggtgatgccgtggctggttgggatgaagtggattaggaagaggttttatgggtttatttcggggtttgggacgacgtattcggggttggcaagtgcgggggagagttgtgtggtcggtggtggtgatggggtgaacacgtcttggtcgtcatggttatggtcatcctcatcctcatcctcatcctcatccttatcattgcggccggagaaggtgagcagcggtgatcgattgccggatggaaaggtaatcgagctagggcggcgatctcatggcgggataacggcttctgacctgttggcaaagagcgaagaaacgagcttgcatcaactttgtcgaggcgcgtcttggcatttgctgttgttctccggaataggtggaacagaaggtcgcgatgcggtgacggtcgagggattgacactggcaggcgagagggtattggcggtggtcaaaaaggaggatcgtggtagtagcgcggggcagcaggggcaacaacgcccgggcgatggtcagctgcagccggtgcagacagctacagctacaactacagctacagctacagctacagggaagagcgccgccgttgcttccacatatacggacccaggtggtcgggtccatggtgtgcttggattggacaatgggcgtgcgggatatgtcatggtgagacctgacggctatgtttctcacgttggatatctgccgtcactgcaggaattcatcaaggagtgggagacgagagtttgtctttga

SEQ ID NO: 100 - protein, 665 aa, Neurospora crassa
MDHCDVLIVGAGPVGTTLALELALQGVSFRIIDKSPARSEKSRALIVHPRTLELLDRHGTVGQLISRGTITRGGVLNINRKLVARMNLDDLDITDTRYPLPLMVSQAETEQFLDESLADYGKAVERAYTATSVVQDANGVTTTLEKPDGTQTTVRSKYVVGCDGAHSLVRHSAQNLSFDGDAYPQDFILCDARLRNSSVARDRFTICFGDTGLLAFFPIQSSHSESKGEEGLIRLIASGGRSVLKDSSGSGSGSPVVPAAEQQQQQQQRQHGEQTHEPPTLAHFQSLVDSIAPPGSGTVHSPIWLARFRLHHRGVNSYRSDRLFVAGDAAHIHSPAGGQGMNVGIQDAINLGWKLGTVLKYRDSLTEEAREALLDSYHAERYPVGRALLQGTDRIFSFTAAATSWVLKVRNTVLPWVMPWLVGMKWIRKRFYGFISGFGTTYSGLASAGESCVVGGGDGVNTSWSSWLWSSSSSSSSSSLSLRPEKVSSGDRLPDGKVIELGRRSHGGITASDLLAKSEETSLHQLCRGASWHLLLFSGIGGTEGRDAVTVEGLTLAGERVLAVVKKEDRGSSAGQQGQQRPGDGQLQPVQTATATTTATATATGKSAAVASTYTDPGGRVHGVLGLDNGRAGYVMVRPDGYVSHVGYLPSLQEFIKEWETRVCL

SEQ ID NO: 101 - DNA, 1182 bp, Xylella fastidiosa
  CDS (1)..(1182)
atgaaccgaactcagcgaccggatgtactcatcactggcggcggcgtcgtcggtgccagcagcgccctggcattggcgaaaacagggttacacgtcgccttgattgaaaaatacgaaccaccgcgttggcaagcaacggttccggatctgcgtgtctacgcatttgccccggacagtgccgcactcctgcgcaccttcaacgtatggccgaccgtgtgcgcgacacgcgcccagccataccatcacatgcggatctgggacagtggcggagcggatgaattgcacttcgacgctgccacattgggctgcgaacaactcggctggatcgtcgagaacgcactcctagtcaaccagttgtggtctgcacttgcggatgccggcgtacaactgcattgccctgcacggatcaccgccctagagcaagacaccgacagagtgcgtttacgcttggaggacggccggcgactcgaagcacgcctggccatcgctgccgacggcgccgactccaccttgcgtcaattggcgcacctgccagtacaccgacatgactatgcacaacgcagcattgtcgcctttgtcgcaaccgaacacccacaccaagccaccgcctggcaatgctttttaccaagcggaccattggcattgctgccatttactgatgagcgcagctcaatcgtctggacgctccccgatgttgaagcgcaacgcctcctgacactggacgaaacaacattcgcacgcgaactcaccactgccttcggtgggcgcctaggacacatacagctcatctcaccacgcaccgcattcccactgcgccgccaactggccaccgactacatcgccggtcgggtactgacactcggtgacgccgcacatgtcgtccacccactggccggacagggcgtcaacctcggtttgcgcgatgtaaccgcattgcaaaccctgatccaacaggcacacacgcgccatgttgactgggccacaccgcaccgcctgcaacgctgggcacggacacgccgcagtgataacaccctcgcggcctacacgttcgatgccattaaccgggtattctccaacgacgcatttcacctcaccctgctacgtggccgggtactgagcttggtcgaccgcctgccaccgctcgtcaacgccctatggcgtcgtgcctcaggggtgaattga

SEQ ID NO: 102 - protein, 393 aa, Xylella fastidiosa
MNRTQRPDVLITGGGVVGASSALALAKTGLHVALIEKYEPPRWQATVPDLRVYAFAPDSAALLRTFNVWPTVCATRAQPYHHMRIWDSGGADELHFDAATLGCEQLGWIVENALLVNQLWSALADAGVQLHCPARITALEQDTDRVRLRLEDGRRLEARLAIAADGADSTLRQLAHLPVHRHDYAQRSIVAFVATEHPHQATAWQCFLPSGPLALLPFTDERSSIVWTLPDVEAQRLLTLDETTFARELTTAFGGRLGHIQLISPRTAFPLRRQLATDYIAGRVLTLGDAAHVVHPLAGQGVNLGLRDVTALQTLIQQAHTRHVDWATPHRLQRWARTRRSDNTLAAYTFDAINRVFSNDAFHLTLLRGRVLSLVDRLPPLVNALWRRASGVN

SEQ ID NO: 103 - DNA, 1179 bp, Vibrio parahaemolyticus
  CDS (1)..(1179)
atgaagcaatatgacgtagtaattgctggtggtgccatggctggggctacactagctttagcgattgagcatttgtctcaaggggctttgcgtgttgccgttgttgaaccgtttaaagcgcaatctgatcagcatccgggctttgattcgcgctcgattgctttgtcttatggtacggttaacctgctgcgtcacttagagttatggtctgcgattgaacctttttcgaccccgattgaacacattcatgtgtccgatcgttctcatgcgggaatgacggacatcactaagcaagacgttggcgttgaagcgttaggttatgtcgtagagttagccgatgttggtcgtgtttaccaagaattgctgactcacagtaccgctatcgatttgtactgcccaaactccgcgaagcacattacccgaactcaagaaaatgtgacgattgagcttgctagcggtgagttgcttaatgcgaaattacttgttgccgccgatggtgcggtttcgcaatgttgtcagcaaattggtttggagctttctgagcatgatttcgaccaagttgccgtaattgccaatattgtgactcaagagccgcatcaaggtcgcgcatttgagcgttttactgaaaacggcccagttgccctgctgccaatgagtgataatcgaatgtcgctcgtgtggtgcttacgtcctgatgaagctcaaattgtaatggaattgtctgaaagcgaatttcttgaacggcttcagcaagattttggttggcgattaggtgcgatgcaaaaagtggggctgcgtgcgagctatccgttgttgcttcgtcaccgtaagcaaaatatttcacaccgttttgcgatagtcggtaacgcagcacaaacgttgcatcctattgctgggcagggcttcaacttggggatccgagacgtggtcactctcgctgaagaactggtcaagcaaggtgaagatgttgggcgttaccaaggcctgattcgctttagtcaacgccgagaagcagaccgcaacgaaaccatttggctaacaagctcgttagtccatgttttttcaaacgatttactcgcgatgcgaattgggcgaaatacagccttagccgcgatggataacctttctatttttaagcagcagctcttgcgccatactcttggtttagtgaaacgatga

SEQ ID NO: 104 - protein, 392 aa, Vibrio parahaemolyticus
MKQYDVVIAGGAMAGATLALAIEHLSQGALRVAVVEPFKAQSDQHPGFDSRSIALSYGTVNLLRHLELWSAIEPFSTPIEHIHVSDRSHAGMTDITKQDVGVEALGYVVELADVGRVYQELLTHSTAIDLYCPNSAKHITRTQENVTIELASGELLNAKLLVAADGAVSQCCQQIGLELSEHDFDQVAVIANIVTQEPHQGRAFERFTENGPVALLPMSDNRMSLVWCLRPDEAQIVMELSESEFLERLQQDFGWRLGAMQKVGLRASYPLLLRHRKQNISHRFAIVGNAAQTLHPIAGQGFNLGIRDVVTLAEELVKQGEDVGRYQGLIRFSQRREADRNETIWLTSSLVHVFSNDLLAMRIGRNTALAAMDNLSIFKQQLLRHTLGLVKR

SEQ ID NO: 105 - DNA, 1209 bp, Vibrio parahaemolyticus
  CDS (1)..(1209)
atgatgcaaagtgtagatatcgccatcatcggcggagggatggttgggttggcgcttgccgccgcattcaaagacagtgacctgcgtatcgccgtgatcgaaggtaacgtgccagatgaaacgttgaatgaactgcctgatgtgcgagtttctgcactgagccgctcaagtgaaaccattttacgtaagctaggagcttggcagggtattgagcaacgccgagcttcaccttactacggtatggaagtgtgggagcaagacagcttcgcaaaaatagagtttgatgcacaaaatatggcgcaacctgatttgggtcacatcgttgaaaatcgcgtgattcagttagcgttgttggaacaagtgcaaaagctagagaacgtaacgttattcatgcctgcgcgctgtgcgacactcgcggtcggtgaacaagagagttggttaacgctcgataacggccaagcgatgacagcgaagctggtggtgggcgcagatggcgcgaattcgtggctgcgtaaccagatggatattcctttgacgcattgggactacggtcaccatgcgttggttgctaatgtgaaaacagcggatccgcaccacagcatcgcgcgtcagatttttacacctcacgggcctttggcattcttgccaatgtctaaaccaaacatgtgttctatcgtttggtcgacagagccgaaccgagcggaagaattgctggtcatgagcgatgaagcgttcaacaaaacgctaaccagcgaattcgatgctcgtttaggcgtgtgtgaagtggtgggagagcgagcggcgtttccgctaaaaatgcgttatgcccgagactttgtagttgagcgtgttgcactggttggcgatgcggctcataccatccacccattagcaggccaaggcgtgaatctcggcttattggatgcagccagtctggcgcaagaagtactgactctttggaaacaagggcaagacattggtagtaaacgcaatctgcgtggctatgagcgttggcgtaaggctgaagcggcgaagatgattgcggcgatgcaaggtttccgtgatttattctctggtggccatccagcgaaaaaactggttcgcggtattggcttgagtttagcgggacaattaccgggtgctaaagatgagatcatgaagcgtgcactgggtttgaaggggcacctaccagaactggctcgtcaatag

SEQ ID NO: 106 - protein, 402 aa, Vibrio parahaemolyticus
MMQSVDIAIIGGGMVGLALAAAFKDSDLRIAVIEGNVPDETLNELPDVRVSALSRSSETILRKLGAWQGIEQRRASPYYGMEVWEQDSFAKIEFDAQNMAQPDLGHIVENRVIQLALLEQVQKLENVTLFMPARCATLAVGEQESWLTLDNGQAMTAKLVVGADGANSWLRNQMDIPLTHWDYGHHALVANVKTADPHHSIARQIFTPHGPLAFLPMSKPNMCSIVWSTEPNRAEELLVMSDEAFNKTLTSEFDARLGVCEVVGERAAFPLKMRYARDFVVERVALVGDAAHTIHPLAGQGVNLGLLDAASLAQEVLTLWKQGQDIGSKRNLRGYERWRKAEAAKMIAAMQGFRDLFSGGHPAKKLVRGIGLSLAGQLPGAKDEIMKRALGLKGHLPELARQ

SEQ ID NO: 107 - DNA, 1176 bp, Vibrio parahaemolyticus
  CDS (1)..(1176)
atgaacaagtatgacatcgccgtaatcggtggcggcatggtcggggcagctgtcgcagttggatttgccaagcaaggtagaagcgtagtggtagttgaaggagcggagcctaaagcattcgatgctgctcaagctctggacgtgcgagtttctgctatttcacatcaatcggtgaaattacttgaatcattagatgcttggtcggcgatcgaagcaatgcgcgtctgtccttatcgtcgtctggaaacgtgggagcatcctgagtgtcgtactcgttttcattctgatgagctttcattggatcaacttggctacatcgttgaaaaccgcctaatccaacttggcctttggcaagctttcgcgcaattcgacaacttaacggtgaagtgtcctgagcgattaaaagatatcgacttcaatgatggaaaccgtatcacgctagaaagcggcgaacagtttgatgcgaactggatcattggcgctgatggtgccaattctaaagtacgtcagctagcgggtattggcgtgactgcttgggattaccgtcaacattgtatgctcatcaatgttaagactgagttgccacaacaagacattacttggcaacagttcacccctagtgggcctcgctctttcctacctttgtgttcattgacagaagatggacaagaagtcgggcaaggatctttagtttggtatgattccccaaaacgaatcaaacagctttgcgcgatgaccaaacctcaattaagagaagagatcgtgcgtcactttcctaaagagcttggagatatcgaagttctgcagtttggttctttccctttgacacgtcgacacgcgcagtcctattcgcatagaggttgtgtgctagttggtgattcagcgcatacaatcaatccattagcggggcagggcgtgaatttaggctttaaagacgttgatgtattgctatcagtgacacaagggcaagatgagttaacggatgctctattagcaaaatatgagcgtactcgtcgcccggataatcttctaatgcagaccggtatggattttttctataaaggctttagcaatgatttggggcctttgaagtttgcacgcaatgcagcattaaagctggctgaaaattcagggccgatcaaagcacaagtattgaagtacgcgttaggtatgtag

SEQ ID NO: 108 - protein, 391 aa, Vibrio parahaemolyticus
MNKYDIAVIGGGMVGAAVAVGFAKQGRSVVVVEGAEPKAFDAAQALDVRVSAISHQSVKLLESLDAWSAIEAMRVCPYRRLETWEHPECRTRFHSDELSLDQLGYIVENRLIQLGLWQAFAQFDNLTVKCPERLKDIDFNDGNRITLESGEQFDANWIIGADGANSKVRQLAGIGVTAWDYRQHCMLINVKTELPQQDITWQQFTPSGPRSFLPLCSLTEDGQEVGQGSLVWYDSPKRIKQLCAMTKPQLREEIVRHFPKELGDIEVLQFGSFPLTRRHAQSYSHRGCVLVGDSAHTINPLAGQGVNLGFKDVDVLLSVTQGQDELTDALLAKYERTRRPDNLLMQTGMDFFYKGFSNDLGPLKFARNAALKLAENSGPIKAQVLKYALGM

SEQ ID NO: 109 - DNA, 1230 bp, Pseudomonas syringae
  CDS (1)..(1230)
atggaaacgcgtgcagatgtgttgattgtcggggccggaatggtcggcagtgctcttgcgctggccttgcagggcagtggccttgatgtgctggtggtcgacggcgggccgctgagcgtcaaaccctttgacccgcaatcgactttcgagccacgggtcagtgccttgtcagcggccagccagcgcattctgcagcggcttggcgtgtgggatggcatcgcgtcgcgacgtaccagcccttacgcgcacatgcacgtctgggatggcagcggcaccgggcagatccacttctcggcctctagtgtgcatgccgacgtgctgggccatatcgtcgagaaccgagtggtgcaggatgcgttgctcgaccgtttgcatgacagcgacatcggcctgctggccaacgcgcggctagagcagatgcgtcactccggcgatgactggttgctgacgctggcggacggtcgtttgctgcgtgcgccgctggtggttgccgccgacggtgctaactcggcagtacgccgcctgaccgaaacgccgacgcgcgagtgggattacctgcaccacgccatcgtcaccagcgtgcgcacggccgattcccacaagaaaaccgcctggcagcgtttcacggatgacggcccgctggcgtttctgccgctggaccgtgagggcgagcactggtgttccattgtctggtcggtcacgccagcagaagccgagcgtttgatggtgctggaagatgatctgttctgccgtgagctggagcaggcgttcgagggccggctgggccaggtcttgtctgccgacgcgcgcctgtgcgtgccgctgcgccagcgtcacgccaagcgctacgtcgccaatggcctcgcgctgattggggacgcggcgcacaccattcacccgttggccgggcagggcgtgaacctgggttttctggatgctgcggtgctggcgcaagtgctgacccacgcagcgcagcgtggcgagcgcgtggcagacctgcgcgtgctgggccgctacgagcgtcgccgcatgccgcacaacctggcattgatggcggcgatggagggctttgaacgcctgttccaggccaacccgctgccactgcgctggctgcgtaataccggcctgaaaatggtcaaccaaatgcccgaggccaaggctctgttcgtgcgcgaagccttaggtttgtcgggcgatctgccggagttggcacggcttgacgctcgttag

SEQ ID NO: 110 - protein, 409 aa, Pseudomonas syringae
METRADVLIVGAGMVGSALALALQGSGLDVLVVDGGPLSVKPFDPQSTFEPRVSALSAASQRILQRLGVWDGIASRRTSPYAHMHVWDGSGTGQIHFSASSVHADVLGHIVENRVVQDALLDRLHDSDIGLLANARLEQMRHSGDDWLLTLADGRLLRAPLVVAADGANSAVRRLTETPTREWDYLHHAIVTSVRTADSHKKTAWQRFTDDGPLAFLPLDREGEHWCSIVWSVTPAEAERLMVLEDDLFCRELEQAFEGRLGQVLSADARLCVPLRQRHAKRYVANGLALIGDAAHTIHPLAGQGVNLGFLDAAVLAQVLTHAAQRGERVADLRVLGRYERRRMPHNLALMAAMEGFERLFQANPLPLRWLRNTGLKMVNQMPEAKALFVREALGLSGDLPELARLDAR

SEQ ID NO: 111 - DNA, 1224 bp, Pseudomonas putida
  CDS (1)..(1224)
atggaaatgcgcgcagatctgttgattgtcggtgccggtatggtgggcagcgccctggccttggcgttgcgccacagtggcctgcaaattttgttgctcgatggtggcccgctgacggtcgtacccttcgatgcccaggccccgttcgagccgcgtgtcagcgcgctatcggcggccagccagcgcatcctcgagcgccttggcgcctgggacggcattgcccagcggcgcgccacgccgtattccgacatgcatgtgtgggatggcagcggcaccgggcagattcacttctcggcggccagtgtgcatgcccaggtgctcggccatatcgtcgagaaccgggtggtgcaggacggcctgctggagcgcctgcacgacagcgacatcggcctgctggccaatgcgaggctggagcaattgcgtcgctcgggcgatgagtggctgctgaccctggcggatggccggcaactgcgggcaccgttggtgatcgctgccgacggtgccaattcggcggtgcggcgtctggccggctgcgaaacccgcgagtgggattacctgcaccatgccattgtcaccagcgtgcgttgcagcgccgggcaccaggccacggcctggcagcgcttcactgacgaaggtccgctggcgttcctgccgttgacccgcgatggccagcaggactggtgctcgatcgtctggtcgaccaccccggagcatgccgagcagttgatggcgatggatgaagcggccttcctgcaggccctggagcgggccttcgaagggcgtctgggcgaggtgcttcaggccgacccacgggtgtgcgtgccgctgcgccagcgacacgccaagcgctacgtggatgaaggcctggtcttgatcggtgatgctgcacacaccattcacccactggccgggcagggtgtgaacctcggcttcctcgacgcggcggtgctggctgaggtgctggtcaatgcttgcgagcgcggtgagaggctggccgatgtgaaggtgctgagccgttacgagcgccggcgtatgccacacaacctggcgttgatggcggcgatggagggcttcgagaggttgttccaggccgatccgctgccgttgcgctggttgcgcaacagcgggttgaagctggtggagcagatgccggaggccaaggcgctgtttgtgcgccaggcgttgggtttgagtggtgacctgccggatctggccaaggcttga

SEQ ID NO: 112 - protein, 407 aa, Pseudomonas putida
MEMRADLLIVGAGMVGSALALALRHSGLQILLLDGGPLTVVPFDAQAPFEPRVSALSAASQRILERLGAWDGIAQRRATPYSDMHVWDGSGTGQIHFSAASVHAQVLGHIVENRVVQDGLLERLHDSDIGLLANARLEQLRRSGDEWLLTLADGRQLRAPLVIAADGANSAVRRLAGCETREWDYLHHAIVTSVRCSAGHQATAWQRFTDEGPLAFLPLTRDGQQDWCSIVWSTTPEHAEQLMAMDEAAFLQALERAFEGRLGEVLQADPRVCVPLRQRHAKRYVDEGLVLIGDAAHTIHPLAGQGVNLGFLDAAVLAEVLVNACERGERLADVKVLSRYERRRMPHNLALMAAMEGFERLFQADPLPLRWLRNSGLKLVEQMPEAKALFVRQALGLSGDLPDLAKA

SEQ ID NO: 113 - DNA, 1185 bp, Bradyrhizobium japonicum
  CDS (1)..(1185)
atgacagacgcatcgacactctttgacgcagccgtgatcggcggcggaccggcgggacttagcgcggccatcgcgctggcgcaggcgggtgcacggaccgcgctggtggcgcgccgcctgccctatgccgacaaccgcaccacggcgctgctaggcgcctccgtcgagctgctggagagcctcgacgtctggccgcgctgcaaggacaaggcggccgcgctcgaaatcatgcgcctcgtcgacgacaccggccggctgttccgggcgccggaggtccgcttctcctgtcacgagatcgggctcgacgccttcggctacaacatcgacaaccgctcgctgatgctggcgctggaagagcgcgcggccgaactgcccgggatcgtccgtttcgacgacgaggccgaaagcgtcgtcattgaagccgacgatgtcgcgatccgcacggcctccgcgcaattcctcgcagcccgcctcgtggtcggcgccgacggccggcattcgctgtgccgggaggctgccggcatcgcggtgacgcggcgcgacctgacgcagaccgcgctcaccttcaacgtcggccatgcgcggccgcatcgcaatgtctcgaccgagttccacacgccccacgggccctgcgtgttcgtgcccctgcccggcaaccgctccagcatcgtctgggtcgcagctcccgcggaagcggaacgcctccgcggcttaagcgacgacgagctgtccgccgcgatcgagaagcagtcgcattccatcctgggacgcatgacggtcgagcccggccgcaacctgtttccgctggcgatcgaacgtccgaaatccttcggccgcgaccgcatcgcgctggtcggcgaagccgcccatgtggttcccccgatcggcgcccagggcctcaaccttggcctgcgcgatgccgccgacattgccagacttgcgggcgatgccatcgcctcgggcgaggatcccggcgcgcccgacgtgctcgagcgctacgaccgcgcccggcggcccgacatcctgagccggacctttgcgatcgacatcgccaaccgctccttgctcaacgatttcctgccgctccagccggtccgcgccgtcggcatgcacctgctcggcgccatcggcccgctccggcgcttcgccatgcgggaggggctgacgcctacctggcggcggtaa

SEQ ID NO: 114 - protein, 394 aa, Bradyrhizobium japonicum
MTDASTLFDAAVIGGGPAGLSAAIALAQAGARTALVARRLPYADNRTTALLGASVELLESLDVWPRCKDKAAALEIMRLVDDTGRLFRAPEVRFSCHEIGLDAFGYNIDNRSLMLALEERAAELPGIVRFDDEAESVVIEADDVAIRTASAQFLAARLVVGADGRHSLCREAAGIAVTRRDLTQTALTFNVGHARPHRNVSTEFHTPHGPCVFVPLPGNRSSIVWVAAPAEAERLRGLSDDELSAAIEKQSHSILGRMTVEPGRNLFPLAIERPKSFGRDRIALVGEAAHVVPPIGAQGLNLGLRDAADIARLAGDAIASGEDPGAPDVLERYDRARRPDILSRTFAIDIANRSLLNDFLPLQPVRAVGMHLLGAIGPLRRFAMREGLTPTWRR

SEQ ID NO: 115 - DNA, 1437 bp, Yersinia pestis
  CDS (1)..(1437)
atgatacttttgctcggcgtacattgggctgggtcgagcgctaactcaatagactcatcgggattaacgcgcctcatcgttgaggtttaccctatggggtggcacaaatgctgttcaaatcgttcccgaccaatttgcttctcgtttgccgcctccctgcatcgagaaatctatagagtaaataaagttcatattttcatggggaaatgtttcggcatgcaatcatttgacatagttatcgccggtggtgggatggtgggtctggcgctggcttgtggtttacaaggcagtggcctgcgtatcgccattatcgagcatcagcctgcaccgatgccattaacggcaccgttgaccggtgagctggcactgcgagtctcggcgatcaacgcagctagtgagcgcttactgcaaaaaatcggggtgtgggaaacgattcaggcactgcgtgctagcccgtaccacggtatggaagtgtgggataaagacagcttcggcaaaattgcctttcatgcggatgaatatggcttcagccatcttggccatatcattgaaaatcaggtcattcaacaagcattgtggcagcgggccagccaactaccagaggtgacggtcttggcacccgccagcttcaaacaagtggcttggggcgagactgaagcgtttatcaccctaaccgatgaccggatgctcagtgctcggctggttgttggggctgatggcgcacactcatggttacgtcagcatgcggatattcctctgaccttctgggattatgcccaccatgccttggtggcaactatccggactgacgagccgcatcaggctaccgcgcgtcaggtattccacggtgacggcattttagctttcctcccctttagcgacccccacctcagttctattgtctggtcattaccgcctgagcgtgccgccgagttagccgtgctgcccgccgagcaatttaaccgtgagttggcgatgacgtttgatatgcgccttgggcaatgtcagcttgagagtgagcggcaaacgttcccgctgaccgggcgttatgcccgtagctttgccgcgcaccggctggtgttggtcggcgatgcggcgcataccgtgcatccattggctgggcagggcgttaatctgggctttatggatgtagccgaattagtgtctgaacttcggcgtttacagcgtcaagggaaggatattggtcagcatctctatctgcgccgttatgaacgccgccgcaaacacagtgctgcgatgatgctggcgagtatgcagggcttccgtgatctgtttgctggcaacaatccggctaaaaaattattacgtgatattgggttaacgctggccgatcacttgccgggggttaaaccgcaattggtacggcaggcgatggggctgaatgatttgccagaatggctggagcgttctcaataa

SEQ ID NO: 116 - protein, 478 aa, Yersinia pestis
MILLLGVHWAGSSANSIDSSGLTRLIVEVYPMGWHKCCSNRSRPICFSFAASLHREIYRVNKVHIFMGKCFGMQSFDIVIAGGGMVGLALACGLQGSGLRIAIIEHQPAPMPLTAPLTGELALRVSAINAASERLLQKIGVWETIQALRASPYHGMEVWDKDSFGKIAFHADEYGFSHLGHIIENQVIQQALWQRASQLPEVTVLAPASFKQVAWGETEAFITLTDDRMLSARLVVGADGAHSWLRQHADIPLTFWDYAHHALVATIRTDEPHQATARQVFHGDGILAFLPFSDPHLSSIVWSLPPERAAELAVLPAEQFNRELAMTFDMRLGQCQLESERQTFPLTGRYARSFAAHRLVLVGDAAHTVHPLAGQGVNLGFMDVAELVSELRRLQRQGKDIGQHLYLRRYERRRKHSAAMMLASMQGFRDLFAGNNPAKKLLRDIGLTLADHLPGVKPQLVRQAMGLNDLPEWLERSQ

SEQ ID NO: 117 - DNA, 1182 bp, Wigglesworthia glossinidia brevipalpis
  CDS (1)..(1182)
atgaaaaaattttttgatattgtaattattggctctggaattttaggaaaaagtttatctataaaattagctaaacatggatttttaataaaattaattgaattagaaaacaaaaaaagtttttcatatgatgaaataccagattttaaaatattagctctaaattattctactataaaatttttatacgatatagacgtatggaataaaattgatctgaaattttgcactaaatataaatatatagaaacttgggaaaattctttttttcctgttaagttttgttctgattcaatagatttatctggattaggttatatcatagaaaatcatagattgaacaaagctttgattgagactgaaaataagtacaaaaaatttataataaaaaattccataggaataagaaatatgtattatgatgatataaaaaaagtatggaaaattatattaaataatggaaaatatatatttagtaatttgataattggagcagatggaaaaaattcttgggtaagaaaaaaatctggaattccttttataaaatttaattatagtcagtcttgcatgttgtttattgtaaaaattagaactaaaaaaaattatactgtatggcaatctatagatttaaatggtccaaaagcatatttgcctttatatgatgattgggcattattaatttggtatgatttaacagaatatttacatgaaataaacaatatgtcttttaatttaatagaaaaattgattatgtctaaatttccaaaaagattaggtccagtcactttacacaaaaaagaaatagtacctttgacttttttatatggatatcagtacgttaaacaagggttagctcttttaggcgatgctgttcatactatacatcctttagctggacaaggaggaaacttaggtttcagagacgtaaaacaactttctgatgtattaattgaatctaaatgcacaaagaaaaattggtatgaattaaatactttaaaaaagtatgaaaataattgcaaaacttataacactattatgcaatttaatatagacttatttcgtttattattttctaatgatatatggattattaaaaaaataagaaatttagctttacattctgtagaatgctctaatttaataaaaaaatttattattaaatatgcttctggtttattttaa

SEQ ID NO: 118 - protein, 393 aa, Wigglesworthia glossinidia brevipalpis
MKKFFDIVIIGSGILGKSLSIKLAKHGFLIKLIELENKKSFSYDEIPDFKILALNYSTIKFLYDIDVWNKIDLKFCTKYKYIETWENSFFPVKFCSDSIDLSGLGYIIENHRLNKALIETENKYKKFIIKNSIGIRNMYYDDIKKVWKIILNNGKYIFSNLIIGADGKNSWVRKKSGIPFIKFNYSQSCMLFIVKIRTKKNYTVWQSIDLNGPKAYLPLYDDWALLIWYDLTEYLHEINNMSFNLIEKLIMSKFPKRLGPVTLHKKEIVPLTFLYGYQYVKQGLALLGDAVHTIHPLAGQGGNLGFRDVKQLSDVLIESKCTKKNWYELNTLKKYENNCKTYNTIMQFNIDLFRLLFSNDIWIIKKIRNLALHSVECSNLIKKFIIKYASGLF

SEQ ID NO: 119 - DNA, 1188 bp, Wigglesworthia glossinidia brevipalpis
  CDS (1)..(1188)
atgaaaataattgtcgtaggtggaggaataattggattagttttttctttagctttgtcaaatttaagcaaaaataaaattaaaattaatttagtagaaattaatgatatttcaaatttaaaaaaaaaaataaataatgatcaatcagttgcaatttcttatcatacaaaaaatatacttaaaaagtttggaatttggaaatatttttcttgtttttccactaaaatcaattctatagagattagtgatcaaaaattttttggaaaaactaaaataaattctagcgaagtttttttatcttctttgggatatgtaatacaattaagaaaaataaaaatattattatttaaaattttaaagaaaaaaagaaatataaaattatattgtccatattatccaaaaaaaataataagagaaaaaaataaaaacattatattattaaataatggaaaaaaattaacatcaaaacttatagttgttgcagatggaatgaattcaaaaatagctaaaaaatgcagtatttaccaaaaaactatattttacaatcaaatagcaatgtctagcaaaatacatgttgatttttttcataaaaattgtgcttttgaaaaattcaataatcatggatctttagcaatattaccattacataaaaatattaattcattaatttggtgttttccgaaaaaattttttgataatattaaatcattaaataaaaaaaaattatctttagaaatacaaaaaatatttggatgggatttgggtaaaatctctttaattgggaaacaaaagtatcatatgcttaagctaagtacttatgaaaatcatatttctcataggttagctcttattggaaatgctgctcaaattatacatcctatagcaggtcaaggattaaatttaggaatgagagatgttatagatctatctaacatattaatagactcttttgaaaaaaagatagattatggaaattatgatgttttaattaagtaccaaaataaaagaaaaaaagatcaaaaaaatacaatttttatgacagaatctcttattaatttattttctagcaaaattcctttaattattataataagaaatttaggattatctataatagaaagatttcctttttttaaaaaaagaataataaaaaacattctgtttaatagatatttaaatattttttaa

SEQ ID NO: 120 - protein, 395 aa, Wigglesworthia glossinidia brevipalpis
MKIIVVGGGIIGLVFSLALSNLSKNKIKINLVEINDISNLKKKINNDQSVAISYHTKNILKKFGIWKYFSCFSTKINSIEISDQKFFGKTKINSSEVFLSSLGYVIQLRKIKILLFKILKKKRNIKLYCPYYPKKIIREKNKNIILLNNGKKLTSKLIVVADGMNSKIAKKCSIYQKTIFYNQIAMSSKIHVDFFHKNCAFEKFNNHGSLAILPLHKNINSLIWCFPKKFFDNIKSLNKKKLSLEIQKIFGWDLGKISLIGKQKYHMLKLSTYENHISHRLALIGNAAQIIHPIAGQGLNLGMRDVIDLSNILIDSFEKKIDYGNYDVLIKYQNKRKKDQKNTIFMTESLINLFSSKIPLIIIIRNLGLSIIERFPFFKKRIIKNILFNRYLNIF

SEQ ID NO: 121 - DNA, 1221 bp, Vibrio vulnificus
  CDS (1)..(1221)
atgtttcgcaaacttgccagtaaaacgtacaatgcaaaaccgtctttgaatcaagttgatcaagagtacaagatgaataaatacgacattgccgtcgtcggtggcggcatggtaggtgcggctgtggccatcggatttgccaaacaaagcagaaaagtcatcgtggttgaagggtttgagccgaaagcgtttgaagcaagccaaccgatggacatccgagtgtccgccatttcccacaactccgtgcgtttgctggaatcgctaggggcctggcaacatattcaagcaactcgagtttgcccctacaaacggttagaaacctgggagcacccagaatgtcgtacacgttttcacagcgatgaactcaatttggagcagctaggttacattgtggaaaaccgtctcattcaattggggttgtggcaagagtttgctcagtacccgaatttgactctgcaatgcccagataaactgaagcgtcttgagttcgatgagttcaacacgttgacgcttgagagtggtttagaaattgaagcctcttgggtcattggcgcagatggtgccaactctcaggtgcgtgagttggctggcattggcattaccgcatgggattatcgccagcattgtatgttgatcaatattgcgacggaatctgcgcaacaggcgatcacttggcagcaatttaccccaagtggcccacgatcttttttgccattgaaaggccagcaaggttctttggtttggtacgattcacccaaacgtattcgcgaattgtcagccatgagcgcagaaaagctgaaacaggaaattattcgtcatttccctgatgaattgggagagtttgacgtgttgtactgggattctttcccattaacccgacgacatgcacaagcctattatcaacaaaattgtttgttgcttggggatgcggcccacacgatcaatccattagccggccaaggcgtcaatcttggttttaaagacgttgaagcgttactcaaggcgacggaaaaccaacctttgacagtggctcaacaagcggcctatcagaaagcacgctatgcggacaacttgctaatgcaaactgggatggatctgttctacaaaggctttagtaacgatatcaccccattaaaattggttcgtaacgcagccctcaagttggctgagcactctgggcctatcaaacatcaagtgttgaaatatgcgctaggaatgtga

SEQ ID NO: 122 - protein, 406 aa, Vibrio vulnificus
MFRKLASKTYNAKPSLNQVDQEYKMNKYDIAVVGGGMVGAAVAIGFAKQSRKVIVVEGFEPKAFEASQPMDIRVSAISHNSVRLLESLGAWQHIQATRVCPYKRLETWEHPECRTRFHSDELNLEQLGYIVENRLIQLGLWQEFAQYPNLTLQCPDKLKRLEFDEFNTLTLESGLEIEASWVIGADGANSQVRELAGIGITAWDYRQHCMLINIATESAQQAITWQQFTPSGPRSFLPLKGQQGSLVWYDSPKRIRELSAMSAEKLKQEIIRHFPDELGEFDVLYWDSFPLTRRHAQAYYQQNCLLLGDAAHTINPLAGQGVNLGFKDVEALLKATENQPLTVAQQAAYQKARYADNLLMQTGMDLFYKGFSNDITPLKLVRNAALKLAEHSGPIKHQVLKYALGM

SEQ ID NO: 123 - DNA, 1275 bp, Synechococcus elongatus
  CDS (1)..(1275)
atgatgacatcggcctttgcaccctcagaacagtcgctggttgcttctcctcaagatctgcccgcggtggatgtggcgattgtcggtgccgggattgtgggtctcagtctggcctgtgcgctacgcaacagtgggctagcgatcgccctcattgaggcaactccctacaggcgggaaaacaccaagggtcaagcctatgccctgcaccaagtgtctcgttacttctttgaggaaatcggggtgtgggataagcttatgccccatgtgcagccctttgaggtggtgcaactctccgatgaacggtttcccttgacagttcacttttccccagcagatctgggcacggaagcccttggttatgtgggtgagcactcagcgatcgccgagaccctgcagagcgttttacagtctgccggcaatgtcacgttctactgcccgtggcgggtagtgaccaacgaagtccacggcgatcgcgctcagttgaccctcatttctggtgaccctggggaacccaaggtggctcacttggcagcccgtttagtggtcgccgcagatggtggcaagtctcccctacggcagcagatggggattgaacctaagggatggcaatatcctcagtcctgtgtggttgccaccctcgatgttgcccatccccaacctgtgattgcctacgagcgcttttggccgacaggaccaatgggcgtgctacccctaccgcggaatcgctatcgagtggtttggacactgccccacccagaggcggaagccgttgctgccctcgacgatcgcagctttttggcaacacttcagccctatcttgatccccagatggcggagattacggctgtgggcgatcgctttgtctttccagcccaattcatgcaagttaactcctacgcggcggatcgctttgtggttattggcgatgcagcccaccgctgccatcccgtggggggacaaggactcaatttgggactacgggatgtatggaatctggcacagcagattttggctagcccccttgaggaaattggcgatcgccgacacctgatgcactttcaccgccaacgctggtggcaaaatgtcttgaccctggcctttaccgacttcctgaaccgtctgttttccaatacagggtggcctttggtggcagtacgccgctgcgggctggggctgttgtgcctcttgccgccgttgaagcgtttgctattgcgctttatggccggtcttctactgcccctaccaggcgatcgtgaattccccagaggccgttaa

SEQ ID NO: 124 - protein, 424 aa, Synechococcus elongatus
MMTSAFAPSEQSLVASPQDLPAVDVAIVGAGIVGLSLACALRNSGLAIALIEATPYRRENTKGQAYALHQVSRYFFEEIGVWDKLMPHVQPFEVVQLSDERFPLTVHFSPADLGTEALGYVGEHSAIAETLQSVLQSAGNVTFYCPWRVVTNEVHGDRAQLTLISGDPGEPKVAHLAARLVVAADGGKSPLRQQMGIEPKGWQYPQSCVVATLDVAHPQPVIAYERFWPTGPMGVLPLPRNRYRVVWTLPHPEAEAVAALDDRSFLATLQPYLDPQMAEITAVGDRFVFPAQFMQVNSYAADRFVVIGDAAHRCHPVGGQGLNLGLRDVWNLAQQILASPLEEIGDRRHLMHFHRQRWWQNVLTLAFTDFLNRLFSNTGWPLVAVRRCGLGLLCLLPPLKRLLLRFMAGLLLPLPGDREFPRGR

SEQ ID NO: 125 - DNA, 1215 bp, Shewanella oneidensis
  CDS (1)..(1215)
atgagccaaacgcagcaatccgcatcgataacatcagagactcaatcctttgatgtgattttagtcggcggcggtatggtgggcgcggcaacggcgattggtcttgcacaacaaggacttcacattgctgtgattgagtcctttgcgcccgaggcttattcccccgagcaggcattagatgtacgtgtgtcggcgataagcgttgcctctgagcatttacttgagcagttaggcgcgttagacagcctccttaagatgcgtaatgtgccttatctgggtttagagacttgggagcttgatggttgcattactcaattccacagctcccaaatcggtgctagccatttaggccatatcgttgaaaaccgtttagtgcagctcgccctttgggagcaaatgcaacaatgggaaaatattcggctcttttgccctgagcgcgttgcccactttgctcgcggggttgatacggtaagcgtgcacttacaatctggttgcctccttgaagcaaagcttttggtcggtgccgatggcgcgaactcacatgtgcgccaatgggcgggcattgggatttcgggttgggactatgctcaatcggccatgctgattaatatccaaaccacccaaggtcaacaagatgtgacttggcagcaatttacccctagcggcccacgttccttattaccgttacccggcaatcatgcctcgttagtttggtatgatgatgccaatcgcatcaaacagttaatgcaactgaacaataagcagttggccgagcaaattcgccagcattttcctgctcggttagatagtgactttatagttgaagccaagggcagttttgcgctcacccgccggcatgctcaggtttatgttaagccaaatgtggtgattttaggggatgcggcgcacactattaatccgcttgcgggccaaggggttaaccttggatttaaagatgttgaagccttgctttcggtcatcaaggcggcattaacggaggataaaccttggtggtcaaccgaggtattagggaaatatcaggcaaaacgttaccttgataatcagctgatgatgaccaccatggatgtgttttacgcaggctttagtaacgatatcttaccgctaaaattgctgcgtaacggcgcattaaagctcgcaaatatcaattctcccctcaaacaaactgtacttaagtatgcgatggggctcaattag

SEQ ID NO: 126 - protein, 404 aa, Shewanella oneidensis
MSQTQQSASITSETQSFDVILVGGGMVGAATAIGLAQQGLHIAVIESFAPEAYSPEQALDVRVSAISVASEHLLEQLGALDSLLKMRNVPYLGLETWELDGCITQFHSSQIGASHLGHIVENRLVQLALWEQMQQWENIRLFCPERVAHFARGVDTVSVHLQSGCLLEAKLLVGADGANSHVRQWAGIGISGWDYAQSAMLINIQTTQGQQDVTWQQFTPSGPRSLLPLPGNHASLVWYDDANRIKQLMQLNNKQLAEQIRQHFPARLDSDFIVEAKGSFALTRRHAQVYVKPNVVILGDAAHTINPLAGQGVNLGFKDVEALLSVIKAALTEDKPWWSTEVLGKYQAKRYLDNQLMMTTMDVFYAGFSNDILPLKLLRNGALKLANINSPLKQTVLKYAMGLN

SEQ ID NO: 127 - DNA, 1224 bp, Shewanella oneidensis
  CDS (1)..(1224)
atgttaagttcacaagcctatgacattgccattgtgggtggcggcatggtgggactcgccaccgcgataggattggcgcaggctgatcttaatgttgtcgttatcgatgcgggccacacagaggccgtgagcggcgagccaaggcttagggtcagcgcgatcaacaaggcgagccagcgtttgctggagcatcttggcgcttggcactatgtcgatgccagccgcgcgacgccctatcaaaaaatggcggtatgggataaagacggctttggcaaaatcgccttcgatgccagcagcatcagtgaacccagtcttggcgcgattatcgaaaacgacgccatcagctatgccctcgccaagcgtgccagtgaatttgacaatatcacccatatcgaaaaccaacgcttagagcgcattgcctttggtgagcgtgaagcttggttgaccctagctaatagtgccgatgctgaaatagaaagtgtgagcgccgcactcgtgattgccgccgatggcgccaactcttgggtgcgtgagcaatgtaagatcccgttaaccttttgggattatggccaccatgcgatcgtggcgactattcgcagcgagatgccgcaccttgccactgcccgccaagtctttttgcaggacggcccgctggccttcttacctttatatgaagacaacctctgctccatcgtctggtcggtgccgcccgagcgcgccactgaattactggcaatggacaaagtgcaatttgagcgcaatctcaccgccgccttcgatggtcgcctcggcatttgcaagctcgagagcgagcgccaagccttcccgctgcggatgcgctacgcccgtcattttgcccgccaccgtttagtgctcgcgggggacgctgcccacaccattcatccattagccggccaaggggtaaaccttggcttcctcgatgccgccagcattatcgaagttatcagcgaattgcagcaagcgggtaaggatattggcgattatgccgagctgcgcgcgttagagcgttggcgcaaggccgatgcgatggagatgattgcggcgatggaaggctttaagcgcctgttcgagggttcaaacccagttaaaaaggcgattcgcgatctgggactcaaccttgtcgataatgtcgctgggctgaaaacagtgttcatgcaacaggccatgggtaataagtcgtcgctgcccaagttatgtcgctag

SEQ ID NO: 128 - protein, 407 aa, Shewanella oneidensis
MLSSQAYDIAIVGGGMVGLATAIGLAQADLNVVVIDAGHTEAVSGEPRLRVSAINKASQRLLEHLGAWHYVDASRATPYQKMAVWDKDGFGKIAFDASSISEPSLGAIIENDAISYALAKRASEFDNITHIENQRLERIAFGEREAWLTLANSADAEIESVSAALVIAADGANSWVREQCKIPLTFWDYGHHAIVATIRSEMPHLATARQVFLQDGPLAFLPLYEDNLCSIVWSVPPERATELLAMDKVQFERNLTAAFDGRLGICKLESERQAFPLRMRYARHFARHRLVLAGDAAHTIHPLAGQGVNLGFLDAASIIEVISELQQAGKDIGDYAELRALERWRKADAMEMIAAMEGFKRLFEGSNPVKKAIRDLGLNLVDNVAGLKTVFMQQAMGNKSSLPKLCR

SEQ ID NO: 129 - DNA, 1224 bp, Shewanella oneidensis
  CDS (1)..(1224)
atgacggtagcagatcacatggataattcagttcaaaacgtcgatatcgccattgtcggtggcgccatggcgggtgcgaccctcgcgttagctttggctcgtttgtctggtactgaaaaacctttatctattgccttaatagaggcgcatcttcccgatcacaatcaccccggctttgacgcccgttctattgccattgcccatggctctatcttcgagttatcccgcttaggtttatggccaaaattggcgcatttaggcacggcgatcaaagatatccatatatccgatcgcggtcattttggtatgacggaactcaacgccagtcagtttcatttagatgcgctgggtcacgttgttgagctggaaagggtcggccaagtgctgtttagcgagcttaacaaaactcaggttaagctctattgcccagccaaactgtcagagttaattcccgatatcgacagccacacgctggtgctggattccggcgagcgtatttgcgccaagctggtggtcgccgccgatggcttgcagtctaaggtgcgcagcagtttttatctgcccattacccaagtggcgtttgagcaaaccgcgattatcgctaatctgcaaaccgataagccgcatcagcattgggcttatgaacgatttactgaaaccggcccgctggcgttattgccgatggctgatagccaaggccagccgcggttatccttagtgtgggcgctcgatcatcaccgcgctcaaacgatgctcaatgccccaaaagccgaatttttagctgagttgcagcaagcctttggttatcgcgccgggcagtttatcgatgtcagcgagcgccatgcttatccgttaaacctgtcctatatgccaaggccaattcaccatagatgtgtgtttattggtaatgcggcgcagacactgcacccgattgcagggcagggatttaacttaggccttcgagatgtggtgagcttgcttgaagtgctcaacactgctcgagagcagggcgaagatatcggctccgccgccgtgacccatgcttatcttcatgtccgcgagcacgacagaaacagcactatccgcaatattgaatttttagtccgtggcttctctaaccaatattggcccttggcccttgggcgtaatctgggattacggctgttatcttggttcccgccactgaaaacccccgtcgctcaaaaagcgatgggctggaaataa

SEQ ID NO: 130 - protein, 407 aa, Shewanella oneidensis
MTVADHMDNSVQNVDIAIVGGAMAGATLALALARLSGTEKPLSIALIEAHLPDHNHPGFDARSIAIAHGSIFELSRLGLWPKLAHLGTAIKDIHISDRGHFGMTELNASQFHLDALGHVVELERVGQVLFSELNKTQVKLYCPAKLSELIPDIDSHTLVLDSGERICAKLVVAADGLQSKVRSSFYLPITQVAFEQTAIIANLQTDKPHQHWAYERFTETGPLALLPMADSQGQPRLSLVWALDHHRAQTMLNAPKAEFLAELQQAFGYRAGQFIDVSERHAYPLNLSYMPRPIHHRCVFIGNAAQTLHPIAGQGFNLGLRDVVSLLEVLNTAREQGEDIGSAAVTHAYLHVREHDRNSTIRNIEFLVRGFSNQYWPLALGRNLGLRLLSWFPPLKTPVAQKAMGWK

SEQ ID NO: 131 - DNA, 1179 bp, Escherichia coli O6
  CDS (1)..(1179)
atgagcgtaatcatcgtcggtggcggcatggcgggcacgacgctggcgctggctatttcccggttaagtcacggggcgctgccagtacatttgattgaagcgaccgcgccagagtcacatgcgcatccgggctttgatggacgagctattgcgctggcggcgggtacctgtcagcaactggcgcgcatcggcgtctggcaatctctggctgattgcgcaactgccatcaccacagtgcatgtcagcgatcgtggtcacgctggatttgtcaccctcgccgcagaagattaccaactggcggcgctggggcaggttgtcgaattgcacaatgtcgggcaacggctgtttgcattgctgcgcaaagcacctggtgtaacgctgcattgccctgatcgcgtggctaacgttgcccgtactcagagccacgttgaagtgacgctggagagtggtgagacgctgacgggccgcgtgctggtagccgctgatggcacccattcagcgttagccaccgtgtgcggcgttgactggcagcaggatccttacgaacaactggctgtgattgcgaacgttgcgacttccgttgcgcatgaagggcgcgcttttgaacgctttacgcaacatggcccgctggcgatgttgccgatgtctgacggacgctgttcgctggtctggtgtcatccactggaacggcgcgaagaggtgctgtcgtggagcgacgagaagttttgccgtgaactccagtcggcctttggctggcgacttgggaaaattactcatgccggtaaacgcagtgcttatccgctagcgctaacccgcgccgccaaacctattacccatcgtaccgtgctggtgggcaatgcggcgcaaactctgcatcccatcgccgggcaaggatttaacctcggtatgcgtgatgtcatgagccttgcggaaaccctgactcaggcgcaggaacgcggagaagacatgggtgattacggcgtattgtgccgttatcagcagcgtcgacagagcgatcgcgaagcaaccatcggcgtcacggacagccttgtacatctttttgccaaccgttggacgccgctggttgtcgggcgcaacatcgggctgatgacgatggaattatttaccccagcacgcgatgtgctggcgcagcgcactcttggttgggtggcgcgttga

SEQ ID NO: 132 - protein, 392 aa, Escherichia coli O6
MSVIIVGGGMAGTTLALAISRLSHGALPVHLIEATAPESHAHPGFDGRAIALAAGTCQQLARIGVWQSLADCATAITTVHVSDRGHAGFVTLAAEDYQLAALGQVVELHNVGQRLFALLRKAPGVTLHCPDRVANVARTQSHVEVTLESGETLTGRVLVAADGTHSALATVCGVDWQQDPYEQLAVIANVATSVAHEGRAFERFTQHGPLAMLPMSDGRCSLVWCHPLERREEVLSWSDEKFCRELQSAFGWRLGKITHAGKRSAYPLALTRAAKPITHRTVLVGNAAQTLHPIAGQGFNLGMRDVMSLAETLTQAQERGEDMGDYGVLCRYQQRRQSDREATIGVTDSLVHLFANRWTPLVVGRNIGLMTMELFTPARDVLAQRTLGWVAR

SEQ ID NO: 133 - DNA, 1203 bp, Escherichia coli O6
  CDS (1)..(1203)
atgcaaagtgttgatgtagccattgttggcggcggcatggtcgggctggcggttgcctgcggcttacagggtagcggcttacgcgttgccgtactggagcagcgcgtaccggaacctctggcggcggatgcaccaccacaactgcgcgtttcggctatcaatgccgccagcgaaaaattactgactcgtcttggcgtctggcaggacattctctctcgtagggccagttgctatcacggtatggaagtgtgggacaaagacagttttggtcacatctcgtttgacgatcaaagcatgggctataaccatcttgggcatatcgttgaaaactcagtgattcactacgcgctgtggaacaaagcgcagcagtcgtcagatatcactctgttggcccccgcagaattacagcaggtcgcctggggagaaaatgaaaccttcctgacgttgaaagatggcagcatgttaacggcgcgtctggtgattggcgcagacggcgctaattcctggttgcgcaacaaagccgatattccgctgactttctgggattatcagcatcacgcgctggtggcgaccattcgcacggaagaaccgcatgatgcggtggcgcggcaggttttccatggcgaaggcattctggcctttttaccgcttagcgatccgtatctttgctcgattgtctggtcactgtcgccagaggaagcgctgcggatgcagcaggctagtgaagacgaatttaatcgcgcgttaaatatcgcttttgataatcgcctgggcttatgcaaggttgaaagtgagcgcctggtgttcccgctaacggggcgttatgcgcgccagtttgccgcgcaccgtctggcgctggtgggcgacgccgcgcataccattcacccgttggcggggcagggggtaaatctcggctttatggatgctgcagagctgattgctgaactgaaacggttgcatcgtcagggtaaagacatcgggcagtacatttacctgcgtcgctatgagcgtagccgcaagcacagcgcggcgctgatgctggctggtatgcagggattccgcgatctgttttccggggctaatccggcgaaaaaattgctgcgtgatattggtctgaaactggctgatacgcttcctggcgttaagccacaacttattcgtcaggcaatgggattaaacgatttgcctgaatggctgcgttaa

SEQ ID NO: 134 - protein, 400 aa, Escherichia coli O6
MQSVDVAIVGGGMVGLAVACGLQGSGLRVAVLEQRVPEPLAADAPPQLRVSAINAASEKLLTRLGVWQDILSRRASCYHGMEVWDKDSFGHISFDDQSMGYNHLGHIVENSVIHYALWNKAQQSSDITLLAPAELQQVAWGENETFLTLKDGSMLTARLVIGADGANSWLRNKADIPLTFWDYQHHALVATIRTEEPHDAVARQVFHGEGILAFLPLSDPYLCSIVWSLSPEEALRMQQASEDEFNRALNIAFDNRLGLCKVESERLVFPLTGRYARQFAAHRLALVGDAAHTIHPLAGQGVNLGFMDAAELIAELKRLHRQGKDIGQYIYLRRYERSRKHSAALMLAGMQGFRDLFSGANPAKKLLRDIGLKLADTLPGVKPQLIRQAMGLNDLPEWLR

SEQ ID NO: 135 - DNA, 1197 bp, Escherichia coli O6
  CDS (1)..(1197)
atgctaacaggattattgaccatgacaaatcaaccaacggaaattgccattgtcggcggaggaatggtcggcggcgcactggcgctgggactggcacagcacgggtttacggtaacggttattgaacatgcccagcctgcgccgtttgttgcggacagccagccggacgtgcggatctcggcgatcagcgcggcttcggtatcattgcttaaaggggtaggggcctgggatgcagtacaggctatgcgttgccatccttaccgcagactggaaacgtgggagtgggaaacggcgcatgtcgtgtttgacgccgctgaacttaagctaccgttgcttggctacatggtggaaaacactgtcctgcaacaggcgttgtggcaggcgctggaagcgcatccgaaagtaacgttacgtgtgccaggctcgctgattgcactgcatcgccataatgatcttcaggagctggaactgaagggcggtgaaacgatcctcgcgaagctggtgattggtgccgacggcgcaaattcgcaggtgcgacagatggcgggaattggcgttcatgcctggcagtatgcgcagtcgtgtatgttaattagcgtacagtgtgagaacgatcccggcgacagcacctggcagcaatttaccccggacggaccgcgtgcgtttctgccgttgtttgataactgggcatcgctggtgtggtatgactctccggcgcgcattcgccagttgcagaatatgaatatggcgcagctacaggcggaaatcgtgaagcatttcccgtcgcgtcttgggtatgtaataccgcttgccgctggcgcgtttccgctgatacgtcgccatgcgttgcagtatgtgcagccggggcttgcgctggtgggcgatgccgcgcataccatccatccgctggcggggcagggggtgaatcttggttatcgtgatgtcgatgccctgattgacgttctggtgaacgcccgcagctacggcgaagcgtgggccagttatcctgtgctcaagcgttaccagatgcggcgtatggcggataacttcatgatgcaaagtggtatggatctgttttatgccggattcagcaataatctgccaccgctgcgttttgtgcgtaatcttggtttgatggcggcggagcgtgctggcgtgttgaaacgtcaggcgctgaaatatgcgttagggttgtag

SEQ ID NO: 136 - protein, 398 aa, Escherichia coli O6
MLTGLLTMTNQPTEIAIVGGGMVGGALALGLAQHGFTVTVIEHAQPAPFVADSQPDVRISAISAASVSLLKGVGAWDAVQAMRCHPYRRLETWEWETAHVVFDAAELKLPLLGYMVENTVLQQALWQALEAHPKVTLRVPGSLIALHRHNDLQELELKGGETILAKLVIGADGANSQVRQMAGIGVHAWQYAQSCMLISVQCENDPGDSTWQQFTPDGPRAFLPLFDNWASLVWYDSPARIRQLQNMNMAQLQAEIVKHFPSRLGYVIPLAAGAFPLIRRHALQYVQPGLALVGDAAHTIHPLAGQGVNLGYRDVDALIDVLVNARSYGEAWASYPVLKRYQMRRMADNFMMQSGMDLFYAGFSNNLPPLRFVRNLGLMAAERAGVLKRQALKYALGL

SEQ ID NO: 137 - DNA, 1245 bp, Brucella suis
  CDS (1)..(1245)
atggctggccagaaaaatacggacgccccacgcaataacgatgtggtgattgcaggcggcggctatgtcggccttgtcacggcggttgcgatcaagtcagccgcgccccacctttccgtcaccgtgatcgatggcgcgcctgcgggcgcgtggaagaacgacccgcgcgcctcctccattgccgccgccgcctcgcggatgctctacaagcttggctgctggcaggaaatcgttcccgaagcccagcccatcaccgaaatggtcattaccgattcgcggacatccgatcccgtgcgccccgtcttcctcaccttcgagggggaggtggaaccgggcgaacccttcgcccatatggtcgagaaccgcgtgctcaacaccgcattgcacaacaaggcggatgcgctcggcatcaccttccttgaagcggtgagcgtggagaattttgaaacccggccggaaggcgtaaccgtcacgctggccaatggcgacaggctggaaacccgccttttgatcgccgccgatggcgctcgctcgcgactgcgcgatctggcaggcatcaagaccgtcaattgggactatggccaatccggcattgtctgcaatgtggcgcatgagcgcccgcatggaggccgcgccgacgagcattttctgcctgccggcccctttgcgatccttccgttgaagggcaatcgctgctcgctcgtctggacggaacgcacggcagacgccgaacggcttatccgcgaggatgatttcgttttcgaggccgaactggaacagcgttttggccaccgcctcggcgccctgcatgtcgaaggcccacgccgcgccttcccgcttggcctgacactggcgcgcgaattcgtaaagccccgctttgcgcttgtgggcgacgccgcccaccgcatccacccgatcgccggtcagggcctcaatctcggcttccgcgatgcggcggcgattgccgaagtggtggtcgaaacggaccgcctcggcctcgatatcggttcctttgcagcccttgagcgctatcaggcctggcgtcgcttcgatacggtgcagatgggcgtcaccaccgacattctgaccaagcttttttccaacgacaatccggcggtgcgttccatccgcgacatcggcctcggccttgttgatcgcgttccaagcctcaaatccttcttcatcaaacaggcggccggtctttccggcgatacgccgcgccttttgaaaggcgagcctatctga

SEQ ID NO: 138 - protein, 414 aa, Brucella suis
MAGQKNTDAPRNNDVVIAGGGYVGLVTAVAIKSAAPHLSVTVIDGAPAGAWKNDPRASSIAAAASRMLYKLGCWQEIVPEAQPITEMVITDSRTSDPVRPVFLTFEGEVEPGEPFAHMVENRVLNTALHNKADALGITFLEAVSVENFETRPEGVTVTLANGDRLETRLLIAADGARSRLRDLAGIKTVNWDYGQSGIVCNVAHERPHGGRADEHFLPAGPFAILPLKGNRCSLVWTERTADAERLIREDDFVFEAELEQRFGHRLGALHVEGPRRAFPLGLTLAREFVKPRFALVGDAAHRIHPIAGQGLNLGFRDAAAIAEVVVETDRLGLDIGSFAALERYQAWRRFDTVQMGVTTDILTKLFSNDNPAVRSIRDIGLGLVDRVPSLKSFFIKQAAGLSGDTPRLLKGEPI

SEQ ID NO: 139 - DNA, 1179 bp, Xanthomonas campestris
  CDS (1)..(1179)
atgcagacggtggatatcgcggtgatcggtgccgggccggttggcctggcgtttgcacggacgctggccggcagcgggttatcggtcacgttgatcgaccagcaatcgcgcgaacaccttgccgatccggccttcgatggacgcgagatcgcgctgacgtatgcatcgcgcgcgctgctggaaacgtgtggcctctggcagcacgtgtcgcccgatgcgatctcgccactgcgcgatgcgcgggtaatggacggccattcaccgtttgcgctgactttcgcatccgccgcgcggcacgccggcgacctgggctggctggtacccaatcatctgatccgccgcgccgcgtggcaggccgtgcaggcgcagccggggctggagatccgctgcggccatcgcgtgcgcgcgctacagcacacgcccacgcgtgtgtgtgtggaactcgccgatggggcgcggctgtcggcgcggctgctggttgcagccgacagccggttttccagcacgcggcggttgcttggcatcggcgcgcagctgcgcgatttcggcaagaccatgttggtgtgccgcgtgcgccatgcagtgccgcaccaccatgcagcctgggagtggtttggctatggcaagacgctggccttgctgccgctgaagggcaaccgcgctggcgccgtgctgaccttgccgccacgccaggtcgaggctttgctggcgatggacgcgcgcgcgttcggcgcggcggtgacggacgccttcgaacaccggctcggcccgatgcagcaggacggcagccgccatgcgtatccgttgatcgcaacctatgcacaacagtttgccggcgagcgtgcggcgttgatcggcgatgcggcggtgggcatgcacccggtcaccgcgcacggcttcaacttcgggttgcaaagccaggcgcgtctggccgagcgcgtgctggccgcggccgcgcgcggtggcgatatcggcgccgcagcggtcgtgcagggatatgcgcgcgcgcatcgtctggcgacgcgcccgctgtatgaagcaaccaatgcactggccgcgctgtacaccgacgatcgtgcaccggcccgcttgctgcgacgtggcgccttgcgtgcggccaatgcggtggcgccgttcaagcaggcgattgcagcgcatctgacccagcggagcgtttga

SEQ ID NO: 140 - protein, 392 aa, Xanthomonas campestris
MQTVDIAVIGAGPVGLAFARTLAGSGLSVTLIDQQSREHLADPAFDGREIALTYASRALLETCGLWQHVSPDAISPLRDARVMDGHSPFALTFASAARHAGDLGWLVPNHLIRRAAWQAVQAQPGLEIRCGHRVRALQHTPTRVCVELADGARLSARLLVAADSRFSSTRRLLGIGAQLRDFGKTMLVCRVRHAVPHHHAAWEWFGYGKTLALLPLKGNRAGAVLTLPPRQVEALLAMDARAFGAAVTDAFEHRLGPMQQDGSRHAYPLIATYAQQFAGERAALIGDAAVGMHPVTAHGFNFGLQSQARLAERVLAAAARGGDIGAAAVVQGYARAHRLATRPLYEATNALAALYTDDRAPARLLRRGALRAANAVAPFKQAIAAHLTQRSV

SEQ ID NO: 141 - DNA, 1170 bp, Pasteurella multocida
  CDS (1)..(1170)
atgaaaacatttgatctggttattgtcggtggtggcatggttgggctcactctcgctgctcgcctcgctaacgcaccactacgcattgcgctgattgaggcatttccgccaacaaccccactagaaacagttactcatcgcgtgagtgcgttaaacctggcgagccagcatttactgactcaacttggtgtctggcaagacatcacccacatacgagcaacggaatacaatgccatgcacgtatgggaaaaagatagctttgctcatattcattttacgaccgcaggattaggcatttctcacttagggcatattgttgaaaaccacgtaattcagcaaacattatggcaaaaagtgaatcaacaaaaaaatatcgaaatactcaccgcacttccacaaacattaggcttaaccgaaagccacgccatgctctcactcaatgatggtcaaatggtcgccaccaaattactagtggctgccgatggtgcaaactcttgggtacgcaaacaagcaaacattccacttgtttttagagattatggacatcatgcattagtttgtaacgtagcaaccacagaaccgcaccaacattgcgcacgccagatattctcaaaagacagtatccttgccttcttacccttacatcaacaacacctttgttcgatagtttggtcacaacctggagaacaagcagagcaccttgcacaatgtgatgaagaagaatttaatcgcgcattatctgtcgcctttgatatgcatctgggattatgtcaagttcaaggggaaagacaagcgattaagttaacagcacgttatgcccgtgattttgctcaaaatagaattgcgctcgtaggtgatgcagcacacactattcatcctctagcaggtttaggggtcaatttaggcttacaagatgttatcgaattggcgcggacaatagaagaaaatataaaagcagatgtggatattggacaatatcgttatttacgccactatgaacgtaaacggaagaaagagaccatgaaaatgttacttgtcatgcaaggcttaaaagatcttttccatggagctcatccaatcaagaaaatgatcaggggcattggattgagtgcaactgataaatttagccttgtcaaaacagaattaatgaaacaagccttaggattataa

SEQ ID NO: 142 - protein, 389 aa, Pasteurella multocida
MKTFDLVIVGGGMVGLTLAARLANAPLRIALIEAFPPTTPLETVTHRVSALNLASQHLLTQLGVWQDITHIRATEYNAMHVWEKDSFAHIHFTTAGLGISHLGHIVENHVIQQTLWQKVNQQKNIEILTALPQTLGLTESHAMLSLNDGQMVATKLLVAADGANSWVRKQANIPLVFRDYGHHALVCNVATTEPHQHCARQIFSKDSILAFLPLHQQHLCSIVWSQPGEQAEHLAQCDEEEFNRALSVAFDMHLGLCQVQGERQAIKLTARYARDFAQNRIALVGDAAHTIHPLAGLGVNLGLQDVIELARTIEENIKADVDIGQYRYLRHYERKRKKETMKMLLVMQGLKDLFHGAHPIKKMIRGIGLSATDKFSLVKTELMKQALGL

SEQ ID NO: 143 - DNA, 1176 bp, Pasteurella multocida
  CDS (1)..(1176)
atggacgtcatacaaaaagacatgatcgtggttggcggtggcatggttggtgcagcctgtgcgcttggcttaggtaaacaaggacatcaagtccagcttatcgaacacgccccactcccacagtttcaacctaattcgccttacgatcttcgcatttctgcgatcagtgttgcttccgttaatctcttaaaacaattaggtgcttggcagtatatcgaaaatactcgtatttgcccgtatcgcgccttagaaacctgggagatcgaaggatttgggaccactttccatagtcaagaattaaacttacctgagctgggttttatgatagaaaataatgttgtacaacttggtttgtggcaggcaatttcaagcattgaaaacatccaaacttgcgtaggatgtactatccaaaaagtcgaaaagtgcggtgaaaattggcaaattttgttagctaatggtacaacttaccaagcccctcttatcattgccgctgatggggcaaattcacagttacgccaaattgctaatattgggacgagtggttggcaatatcgtcaaagctgtttgcttattaccgtcgatactgaacttgaacaacaagatgtcacctggcaacaatttttcccttctggaccaagagcctttctaccattattaggcaaacaagcctgcttagtttggtatgattccccacaacgtatccaaaccctcaaacaactttctcgcgaaaaattagcggcgcaaattgagcaagctttcccggcacgattaggaaaaatcaaagtccaagcagcaaatagctttgagctgactcgaacccatgcgcaagattactttaaacaaggtattgtgctagtaggtgatgctgcacacaccattaatcctcttgctggacaaggtgtgaatctaggttttaaagatgtcaacattctgcttgaagtactacagcaggcgagtcagaaaaaagagcctctcgccagtgatgatgtacttatacgttatcagcgtaaacgtaaacccgataacctattaatgcaaacaggtatggatgtattttataaaacgtttaaagaagatatcttaccgctcaaaatagtacgtaatgcctcattattcctcgccaacaaagcaacgccattgaaaaagcaggcattgaaatatgcattgggtttataa

SEQ ID NO: 144 - protein, 391 aa, Pasteurella multocida
MDVIQKDMIVVGGGMVGAACALGLGKQGHQVQLIEHAPLPQFQPNSPYDLRISAISVASVNLLKQLGAWQYIENTRICPYRALETWEIEGFGTTFHSQELNLPELGFMIENNVVQLGLWQAISSIENIQTCVGCTIQKVEKCGENWQILLANGTTYQAPLIIAADGANSQLRQIANIGTSGWQYRQSCLLITVDTELEQQDVTWQQFFPSGPRAFLPLLGKQACLVWYDSPQRIQTLKQLSREKLAAQIEQAFPARLGKIKVQAANSFELTRTHAQDYFKQGIVLVGDAAHTINPLAGQGVNLGFKDVNILLEVLQQASQKKEPLASDDVLIRYQRKRKPDNLLMQTGMDVFYKTFKEDILPLKIVRNASLFLANKATPLKKQALKYALGL

SEQ ID NO: 145 - DNA, 1161 bp, Gamma
  CDS (1)..(1161)
atggaggttccaattgttatttctggcggagggataataggtaattacatttctcttaggcttgaaaaaaataatatcaaaaccgttattgtcgaaaaagctagtagtttcaaagccctagataagggtataagaacagtcactctcaatgagcattctatgcaaatgctaaaaaatattggtatttgcccatcaattgctcaaatcaacagcatcgacgtattagatggtgagggtacaggcaaaattcaatttctagcaaaggacgtaggcagcgaaaacctttcatatgtaacctatttcaatgaattacaaaaactaatttctgatccatgtaaagaaagaaccttatttaataatgagattgattcagttcagaatcttaatacagaatctgatccagagatcatgcttaaagatggcatgaccataaaaacgaatctaattgctggatgtgatggaagaaattcaaatattgcaaaaattgcttcacttacaagcagcttcgatgactacttacaaacagctttaacttttgtcgttgatattgataatgattcacatggcaaagctcaccaagttttttctgaaaaaggaatatttgcacttatgccactcccagaaggcaagggtgagatgaataaatgcacagtggtttggtcaataaaaaatcaagttttgggagatgagcctgtatctgagtttgtaaaaaataacatttctttttttgaatcaaagcttaatgttagtctcagggttaagtcagaaattttaagttttaaattatcgaaccatcattttgaaaactatattagcggacctattgttcttcttggtgatgctgctcactcaattcaccccttagcaggtcaaggtattaatctaggatttgcagatgcagatactttttgtgaagaggtaattagttcttataaaaaagggattgcctttaatgagaaatcagttttaaaaagatatgagattagaagaaaaagtatgaactttttaatgttgaagtctatggacttttttgtggatttatttggttcagaaaatttatatctaaggctgatcagaaatttaggtatttcttcgttaaataaatcaaagtttgttaaagcattctttataagacatgcctctggaatgaataagttttaa

SEQ ID NO: 146 - protein, 386 aa, Gamma
MEVPIVISGGGIIGNYISLRLEKNNIKTVIVEKASSFKALDKGIRTVTLNEHSMQMLKNIGICPSIAQINSIDVLDGEGTGKIQFLAKDVGSENLSYVTYFNELQKLISDPCKERTLFNNEIDSVQNLNTESDPEIMLKDGMTIKTNLIAGCDGRNSNIAKIASLTSSFDDYLQTALTFVVDIDNDSHGKAHQVFSEKGIFALMPLPEGKGEMNKCTVVWSIKNQVLGDEPVSEFVKNNISFFESKLNVSLRVKSEILSFKLSNHHFENYISGPIVLLGDAAHSIHPLAGQGINLGFADADTFCEEVISSYKKGIAFNEKSVLKRYEIRRKSMNFLMLKSMDFFVDLFGSENLYLRLIRNLGISSLNKSKFVKAFFIRHASGMNKF

SEQ ID NO: 147 - DNA, 1149 bp, Haemophilus ducreyi
  CDS (1)..(1149)
atgaaatctgctgatcttattattattggtggtggaatggttggtttggcgcttgctggcttattaaaagatagcccttgccaaattaaaatcattgaaaaatccgcaccaaaaacccaaaaatactacgccaatcgcgtcagtgcaattaataccgccagtgaaaaaatgttacaacaactaggcgtgtttgagcatataccaaccgatgcttatactgattatcaaaaaataattgtcagtgaaaaagatagctttgcgaaaattgaatttgataacaatgacttagctattaaacaactaggacttacacaattagggcttattattgccaatagccaactacaacaagcattatggcaacaagtcagtcaacaaaagaatgttgaaataatactcagcacacccaaaacgattggcattagtgaaagtggtgcttttcttaccttagaaaatggtgaaatgctggctggcaaactagtagtaggcgctgatggtgcacattcttggctacgtaaccaaattaatatcccattgatcagccaagattatcaacaaactgcactagtctgttgcgttgaaacggcagaaccgcataacaacatcgcccgccaaatttttgggcctgatagcatcttagcttttttacccttagccgataaaaatcagtgttcaattgtgtggtcattaccccccgaccaagccaacaaactaaccacttgtgatgaacaacaatttaaccaagcacttacgattgcttttgactatcaacttggattagtcaaattacaagactcacgaaaaatttacccgcttactgcccgttatgcacgcgatttcgcacaaatgcgaatagcgctaattggtgatgcagcgcatactatccacccactagctggcttaggcgttaatttaggctttgccgacgctatcacactagcagaacaaatcaaattacacttagccgccgcacatgatattggtgaatatcgacatttacgttactttgaacgtacacgtaaaacagaaacaatcaaattattagctgcaatggaaggcttaaaacaattatttagtggaaataatccgcttaaaaaattaataagaggcatcggtttagttggtacaaaccacttttccggctattaa

SEQ ID NO: 148 - protein, 382 aa, Haemophilus ducreyi
MKSADLIIIGGGMVGLALAGLLKDSPCQIKIIEKSAPKTQKYYANRVSAINTASEKMLQQLGVFEHIPTDAYTDYQKIIVSEKDSFAKIEFDNNDLAIKQLGLTQLGLIIANSQLQQALWQQVSQQKNVEIILSTPKTIGISESGAFLTLENGEMLAGKLVVGADGAHSWLRNQINIPLISQDYQQTALVCCVETAEPHNNIARQIFGPDSILAFLPLADKNQCSIVWSLPPDQANKLTTCDEQQFNQALTIAFDYQLGLVKLQDSRKIYPLTARYARDFAQMRIALIGDAAHTIHPLAGLGVNLGFADAITLAEQIKLHLAAAHDIGEYRHLRYFERTRKTETIKLLAAMEGLKQLFSGNNPLKKLIRGIGLVGTNHFSGY

SEQ ID NO: 149 - DNA, 1461 bp, Arabidopsis thaliana
  CDS (1)..(1461)
atgtctaaggacagggtgctcgcaaggaatcttaggacaagtgtctgtggaacaaggattttgcagaggacttgttcgactgttgtgacacatgatgtttctacttcttgttccaatatggttggaatcgctttagctgcttcattggccagcaagccattgacaaagcacttgaatgtcgctattattgacaataatcctcttttggggagaagaaatatcatagagaaagggcatcaacctgatcccagagtcagtacagtcacacctgcaacaatatccttcctcaaagatattggtgcctggaaatacattgagcaacagcgacatgcgtattttgataagatgcaggccttggatatacaagatacaatgctaatgatgtacatcaagatgttttggggtaagcatattgctatatacatctgcatccttgatgatgttaatagctgtgtactcattgttgacatgatccaggaatcagatctccagaagactgtttatcccgcgaggttaaatgcgatggatatgctacctagctcttcgttgacaggtcttggtgaagtaccatccacaacagacttgttcatgcgaggacgccttgctaagctggagctaagcgatggaaatcgcgtctacgcaaaactggtggtaggcgctgatgggtctaagtcgcgagtaagggagttggctgggatcaaaacgactggatggaactactcacagaacgctataatttgtactgttgagcatacagccgaaaactacacagcatggcaacggtttttacccaatggcccaatcgcacttcttcccattggtgacaagtttagcaacatagtatggaccatggacccaaaagaggcatcagatcgaaaattgatgaacgaggatgacttcatcaaagctgtaaatgatgctctggattctggatatggtcctaatccagagactacaagttcacgggatagtctctcttggcttacaggagatgcgaccatatctgccaaagagaggtttgaaactcctcccaaggttgtgaagctttcttcagagagaatgatgttccctttgtctttaaggcacgcaaaagactatgtgtcaaaacgtgtggctcttgttggtgactcagctcatacagttcacccgttggctggtcaaggagtaaatctaggatttgcagatgcgtgtgctctctccaaagctatagcagagggcattgctcttggtactgatataggcgaggcgaatctgctcaaacgttatgaagcagagagaaaacctgcaaatatagcaatgatggcggttttagacggaatccagaagatgtactcgttggatttcggaccgctgaatgctctaagagcagctgcattccacggggctcactacatttcgccgcttaaaaagcgtatcatatcttatgcttcaggagagcaatctttgccgctattttcttga

SEQ ID NO: 150 - protein, 486 aa, Arabidopsis thaliana
MSKDRVLARNLRTSVCGTRILQRTCSTVVTHDVSTSCSNMVGIALAASLASKPLTKHLNVAIIDNNPLLGRRNIIEKGHQPDPRVSTVTPATISFLKDIGAWKYIEQQRHAYFDKMQALDIQDTMLMMYIKMFWGKHIAIYICILDDVNSCVLIVDMIQESDLQKTVYPARLNAMDMLPSSSLTGLGEVPSTTDLFMRGRLAKLELSDGNRVYAKLVVGADGSKSRVRELAGIKTTGWNYSQNAIICTVEHTAENYTAWQRFLPNGPIALLPIGDKFSNIVWTMDPKEASDRKLMNEDDFIKAVNDALDSGYGPNPETTSSRDSLSWLTGDATISAKERFETPPKVVKLSSERMMFPLSLRHAKDYVSKRVALVGDSAHTVHPLAGQGVNLGFADACALSKAIAEGIALGTDIGEANLLKRYEAERKPANIAMMAVLDGIQKMYSLDFGPLNALRAAAFHGAHYISPLKKRIISYASGEQSLPLFS

SEQ ID NO: 151 - DNA, 1356 bp, Caenorhabditis elegans
  CDS (1)..(1356)
atgaaacttccgggtggaactattatttgtgccagaaacgcttcttcttactatgatacggttatcgttggtggcggaatggttggaaatgcaatggcatgttcacttggggccaacaaatcgttccaatcgaaaagtgttctccttcttgacgcgggccgatctccatctctggcatcttttaaaccaggagcaccattcaacaatcgagtcgttgcgacaagtccaacatcaattgatacgttcaaaaaattgggagtttgggatcaaataaattcgcatcgaacaaaaaaagtcaaccgactttttgttttcgatagttgttcaacttcggagattgaattcgaaagaggtcagcaggaagaagttgcgttcattattgaaaatgatttaattgttggatccctctatgaaaaacttgctgaatacaaaaatgtcgatgtgaagactggagcaaaagttgaagactgctccattccgaatgctcttgagaatatggcgacaatcaagttagaaaatggtgatgtgattgaaacgagtcttttgattggtgctgatggtgtcaactcaaaagtgagacatgcttcaaatctggactatactacatttaattataaccagcatggacttgttgctatagttaatatcgagactgcaaacggaaagaatgaaacagcttggcaacggtttacaacactcggaccagttgcacttctgcctctttctgatactgtgtccggtttgacgtggtcaacaagtcccgaagaagctcaacgattgaaacaacttccttctgatcaatttgttgatgaactgaattccgcattgttttcacaaaacaatcaaattcctttggtgaatcagaccattttcgcactgaatcgtatgaatcctttccgaacggaaacttttgggaggaaagctgaaggaacaactccaccacatgtgattactgttcaggacaaaagtcgagcctcatttcctcttggtttcggaaatgctcatagttatatcaccacacgatgcgctttgattggagatgctgctcacagaatgcatccacttgccgggcaaggagtaaaccttggctggagtgatgtgcaaattctagataaagtactcggtgacgctgtgcgtgaaggtgcagacatcggaagcataacatatctgcgagaatatgattcggcggcacaaaaacacaatcttcctgtaatggtgtctgttgatctgctcaatcgtctctaccgtaccgatgctccagctattgttgccgcaagagcttttggcctaaatgcattcaattctttaggacctgtcaaaaactttctgatgaattatttgtccgcacatcgataa

SEQ ID NO: 152 - protein, 451 aa, Caenorhabditis elegans
MKLPGGTIICARNASSYYDTVIVGGGMVGNAMACSLGANKSFQSKSVLLLDAGRSPSLASFKPGAPFNNRVVATSPTSIDTFKKLGVWDQINSHRTKKVNRLFVFDSCSTSEIEFERGQQEEVAFIIENDLIVGSLYEKLAEYKNVDVKTGAKVEDCSIPNALENMATIKLENGDVIETSLLIGADGVNSKVRHASNLDYTTFNYNQHGLVAIVNIETANGKNETAWQRFTTLGPVALLPLSDTVSGLTWSTSPEEAQRLKQLPSDQFVDELNSALFSQNNQIPLVNQTIFALNRMNPFRTETFGRKAEGTTPPHVITVQDKSRASFPLGFGNAHSYITTRCALIGDAAHRMHPLAGQGVNLGWSDVQILDKVLGDAVREGADIGSITYLREYDSAAQKHNLPVMVSVDLLNRLYRTDAPAIVAARAFGLNAFNSLGPVKNFLMNYLSAHR

SEQ ID NO: 153 - DNA, 1579 bp, Drosophila melanogaster
  CDS (49)..(1482)
ataatgaaataatcgtggaattacgagaaacttttgaaatttcggaagatgttgggtgttctacgtatccaaggagcgttggcttcggcggggcaggcgcgtcttctgtccgtccgcctgctggccagcaaatccaccactgacatgaccacaaaccgcggtgaatccacacaatcgacgtccaccgaacactttgatataatcatcggaggcggcggactggtgggcaccacattggccgcagctctggccaagaactcgacgttggcggacaagaaggtactgctgctggaaggtgcgcccgagttccggggatttaatcccactgggccataccagaatcgcgtatccgccatcaatcacaactccatcgagctgttcaagtccattgatgcgtggaagcacatcgagtcggcgcgctacaagcccgtcaagcagatgcaggtgtgggagtccaacacggacgcactgatccagttccagcacgataactttgccagcgacgtggcctgcatcattgagaacgatttgatcctggatgcggtctatgcgctggccaaggaatcacccaatgtggagatcctcaacaaggccagaatccagtgcgttcgcctgcccagggactccaactccaatcactccgagctgcagctagaggatggacgcaacttttcctgcgatttgctgatcggagcggatggcgccaattccgtggtcagaaaggagatgaacgtggatgtattttccctgaactacgaccgcatgggcctggtggctacgctggaactcggcgaagatgcctgtgataattccgtggcgtggcagaggtttctgcccaatggaccagtggcactgctaccactaacggacaggctgagctccctggtctggagcaccaccaacgagcaagcgaaaatgctgcaagccctaccacccacagaattcgtagacgccctcaacgaagccttctgccggcagtatccgcgcgttgagctcgcagacaaggctgtccaggcgctgaactccttgtttggacacaacggcagccagcaccaggtgcaatatccgccacgggtgtgcggcgtgctggacaagtcgcgtgccacgtttccattgggtttcctgcacgcctcgtcgtacgtgtgcaatggagcagctctggtcggtgatgccgcccatcgagtgcatccgctcgccggccagggcgtcaatctgggcttcagcgatgtgcggtatctggtggaatcgctggccgccggtgcatacgccggtttcaagctcggcgacaagcagcatctcatcaaatacgagcgcaagtgtctggcgaagaacgtgcccattatgctgggcgtgcatggactgcacacgctctacgccacgcagttcagtccggtggtcttgctgcgcagcttgggtctgcagctgacccagaacttgccgcccgtcaagaatctgttcatgcgcggagcgatgggtcagtagaacagggacaataaatggggaaatggaaattaaattttaagtgtttactgtttgcacatcacttgtgagcggaataaagtcagagagtttatataac

SEQ ID NO: 154 - protein, 477 aa, Drosophila melanogaster
MLGVLRIQGALASAGQARLLSVRLLASKSTTDMTTNRGESTQSTSTEHFDIIIGGGGLVGTTLAAALAKNSTLADKKVLLLEGAPEFRGFNPTGPYQNRVSAINHNSIELFKSIDAWKHIESARYKPVKQMQVWESNTDALIQFQHDNFASDVACIIENDLILDAVYALAKESPNVEILNKARIQCVRLPRDSNSNHSELQLEDGRNFSCDLLIGADGANSVVRKEMNVDVFSLNYDRMGLVATLELGEDACDNSVAWQRFLPNGPVALLPLTDRLSSLVWSTTNEQAKMLQALPPTEFVDALNEAFCRQYPRVELADKAVQALNSLFGHNGSQHQVQYPPRVCGVLDKSRATFPLGFLHASSYVCNGAALVGDAAHRVHPLAGQGVNLGFSDVRYLVESLAAGAYAGFKLGDKQHLIKYERKCLAKNVPIMLGVHGLHTLYATQFSPVVLLRSLGLQLTQNLPPVKNLFMRGAMGQ

SEQ ID NO: 155 - DNA, 1609 bp, Homo sapiens
  CDS (81)..(1487)
gggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaaaaaaaaaaa

SEQ ID NO: 156 - protein, 468 aa, Homo sapiens
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 157 - DNA, 1512 bp, Mus musculus
  CDS (6)..(1415)
gctccatggcaggcttgctctgcgttcgctggtggagttccgcgcagctcgcagccagaggaggcccgctagttgccagccagcgatgggcgggctcctcggcagacaccgtgtacgacgtggtggtgtcaggaggaggcctagtgggctctgccatggcttgtgccttaggacatgatattcactttcatgacaagaaaatcctgttgctggaggcgggtccaaagaaagccctggagaaactgtcagagacttacagcaacagagtcagctccatatcccctggctccacaaccctgctcagcagttttggtgcatgggaccacatctgcaatatgcgctgcaaagccttccggaggatgcaggtgtgggactcctgctcagaggccttgataatgttcgacagggacaacctggatgacatgggctatatagtggaaaatgacgtcatcatgtatgccctcaccaaacagctggaggctgtggcagatcgagtgaaggttctctatgagagcaaagctgttggctattcctggcctggtgcattttccatggcagactccagcccttgggtccatattaccctaggtgatggcagtaccctccagaccaaactgttgattggtgctgatgggcacaagtcaggagtgaggcaagctgctgggatccagaatgtcagctggaagtacgaccagtctgctgtggtggccactctccacttatcagaggccacagaaaacaatgtagcctggcagagatttcttccctctgggcctattgctctgctcccgctctcggataccttgagctccttggtctggtccacatcacacgagcatgcagcagagctggtcagcatggatgaggaagaattcgtggatgccatcaactctgccttttggagtgatgttcaccacacagacttcgtcgactctgccagcgccatggtgcgccatgctgtcgcccttctgaagcccactaaggtctcagcccgtcagctgcccccaagtatagccaaggtggatgctaaaagcagagccctctttcctctggggctgggacatgctgctgagtacgtccggcctcgggtggccctcattggtgatgcagcccacagaatccatccactcgcgggacaaggtgtcaacatgggcttcggggatatttccagcttggttcatcatctcagtacagcagccttcaatgggaaggacttaggctccatgagccacctcacaggttatgagacagacagacagcgtcataacactgctctcctggctgctactgacctgttgaaaaggctctactctaccagtgccactcccctcgtgctgctcaggacctggggcttgcaggccacgaacgcagtgtctcctctcaaagaacagattatggcctttgcgagcaaatgagtgcttctcttctggagaccgtgatgacaaagaacacctagccctggggccttcccaatgtggtttaataaatttacactagaaaaaaaaaaaaaaa

SEQ ID NO: 158 - protein, 469 aa, Mus musculus
MAGLLCVRWWSSAQLAARGGPLVASQRWAGSSADTVYDVVVSGGGLVGSAMACALGHDIHFHDKKILLLEAGPKKALEKLSETYSNRVSSISPGSTTLLSSFGAWDHICNMRCKAFRRMQVWDSCSEALIMFDRDNLDDMGYIVENDVIMYALTKQLEAVADRVKVLYESKAVGYSWPGAFSMADSSPWVHITLGDGSTLQTKLLIGADGHKSGVRQAAGIQNVSWKYDQSAVVATLHLSEATENNVAWQRFLPSGPIALLPLSDTLSSLVWSTSHEHAAELVSMDEEEFVDAINSAFWSDVHHTDFVDSASAMVRHAVALLKPTKVSARQLPPSIAKVDAKSRALFPLGLGHAAEYVRPRVALIGDAAHRIHPLAGQGVNMGFGDISSLVHHLSTAAFNGKDLGSMSHLTGYETDRQRHNTALLAATDLLKRLYSTSATPLVLLRTWGLQATNAVSPLKEQIMAFASK

SEQ ID NO: 159 - DNA, 27 bp, artificial sequence
  Primer
atgttcttttcaaaagttatgcttact

SEQ ID NO: 160 - DNA, 25 bp, artificial sequence
  Primer
tcatttctcatttcctcctaatgtg

SEQ ID NO: 161 - DNA, 1851 bp, Saccharomyces cerevisiae
  CDS (1)..(1851)
atgaaaaatatcatttcattggtaagcaagaagaaggctgcctcaaaaaatgaggataaaaacatttctgagtcttcaagagatattgtaaaccaacaggaggttttcaatactgaagattttgaagaagggaaaaaggatagtgcctttgagctagaccacttagagttcaccaccaattcagcccagttaggagattctgacgaagataacgagaatgtgattaatgagatgaacgctactgatgatgcaaatgaagctaacagcgaggaaaaaagcatgactttgaagcaggcgttgctaaaatatccaaaagcagccctgtggtccatattagtgtctactaccctggttatggaaggttatgataccgcactactgagcgcactgtatgccctgccagtttttcagagaaaattcggtactttgaacggggagggttcttacgaaattacttcccaatggcagattggtttaaacatgtgtgtcctttgtggtgagatgattggtttgcaaatcacgacttatatggttgaatttatggggaatcgttatacgatgattacagcacttggtttgttaactgcttatatctttatcctctactactgtaaaagtttagctatgattgctgtgggacaaattctctcagctataccatggggttgtttccaaagtttggctgttacttatgcttcggaagtttgccctttagcattaagatattacatgaccagttactccaacatttgttggttatttggtcaaatcttcgcctctggtattatgaaaaactcacaagagaatttagggaactccgacttgggctataaattgccatttgctttacaatggatttggcctgctcctttaatgatcggtatctttttcgctcctgagtcgccctggtggttggtgagaaaggatagggtcgctgaggcaagaaaatctttaagcagaattttgagtggtaaaggcgccgagaaggacattcaagttgatcttactttaaagcagattgaattgactattgaaaaagaaagacttttagcatctaaatcaggatcattctttaattgtttcaagggagttaatggaagaagaacgagacttgcatgtttaacttgggtagctcaaaatagtagcggtgccgttttacttggttactcgacatatttttttgaaagagcaggtatggccaccgacaaggcgtttactttttctctaattcagtactgtcttgggttagcgggtacactttgctcctgggtaatatctggccgtgttggtagatggacaatactgacctatggtcttgcatttcaaatggtctgcttatttattattggtggaatgggttttggttctggaagcagcgctagtaatggtgccggtggtttattgctggctttatcattcttttacaatgctggtatcggtgcagttgtttactgtatcgttgctgaaattccatcagcggagttgagaactaagactatagtgctggcccgtatttgctacaatctcatggccgttattaacgctatattaacgccctatatgctaaacgtgagcgattggaactggggtgccaaaactggtctatactggggtggtttcacagcagtcactttagcttgggtcatcatcgatctgcctgagacaactggtagaaccttcagtgaaattaatgaacttttcaaccaaggggttcctgccagaaaatttgcatctactgtggttgatccattcggaaagggaaaaactcaacatgattcgctagctgatgagagtatcagtcagtcctcaagcataaaacagcgagaattaaatgcagctgataaatgttaa

SEQ ID NO: 162 - protein, 616 aa, Saccharomyces cerevisiae
MKNIISLVSKKKAASKNEDKNISESSRDIVNQQEVFNTEDFEEGKKDSAFELDHLEFTTNSAQLGDSDEDNENVINEMNATDDANEANSEEKSMTLKQALLKYPKAALWSILVSTTLVMEGYDTALLSALYALPVFQRKFGTLNGEGSYEITSQWQIGLNMCVLCGEMIGLQITTYMVEFMGNRYTMITALGLLTAYIFILYYCKSLAMIAVGQILSAIPWGCFQSLAVTYASEVCPLALRYYMTSYSNICWLFGQIFASGIMKNSQENLGNSDLGYKLPFALQWIWPAPLMIGIFFAPESPWWLVRKDRVAEARKSLSRILSGKGAEKDIQVDLTLKQIELTIEKERLLASKSGSFFNCFKGVNGRRTRLACLTWVAQNSSGAVLLGYSTYFFERAGMATDKAFTFSLIQYCLGLAGTLCSWVISGRVGRWTILTYGLAFQMVCLFIIGGMGFGSGSSASNGAGGLLLALSFFYNAGIGAVVYCIVAEIPSAELRTKTIVLARICYNLMAVINAILTPYMLNVSDWNWGAKTGLYWGGFTAVTLAWVIIDLPETTGRTFSEINELFNQGVPARKFASTVVDPFGKGKTQHDSLADESISQSSSIKQRELNAADKC

SEQ ID NO: 163 - DNA, 1575 bp, Homo sapiens (man)
  CDS (1)..(1575)
atgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaa

SEQ ID NO: 164 - protein, 524 aa, Homo sapiens (man)
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 165 - DNA, 1764 bp, Kluyveromyces marxianus var. lactis, Candida sphaerica
  CDS (1)..(1764)
atggcagatcattcgagcagctcatcttcgctgcagaagaagccaattaatactatcgagcataaagacactttgggcaatgatcgggatcacaaggaagccttgaacagtgataatgataatacttctggattgaaaatcaatggtgtccccatcgaggacgctagagaggaagtgctcttaccaggttacttgtcgaagcaatattacaaattgtacggtttatgttttataacatatctgtgtgctactatgcaaggttatgatggggctttaatgggttctatctataccgaagatgcatatttgaaatactaccatttggatattaactcatcctctggtactggtctagtgttctctattttcaacgttggtcaaatttgcggtgcattctttgttcctcttatggattggaaaggtagaaaacctgctattttaattgggtgtctgggtgttgttattggtgctattatttcgtctttaacaacaacaaagagtgcattaattggtggtagatggttcgtggcctttttcgctacaatcgctaatgcagcagctccaacatactgtgcagaagtggctccagctcacttaagaggtaaggttgcaggtctttataacaccctttggtctgtcggttccattgttgctgcctttagcacttacggtaccaacaaaaacttccctaactcctccaaggcttttaagattccattatacttacaaatgatgttcccaggtcttgtgtgtatatttggttggttaatcccagaatctccaagatggttggttggtgttggccgtgaggaagaagctcgtgaattcattatcaaataccacttaaatggcgatagaactcatccattattggatatggagatggcagaaataatagaatctttccatggtacagatttatcaaaccctctagaaatgttagatgtaaggagcttattcagaacgagatcggataggtacagagcaatgttggttatacttatggcttggttcggtcaattttccggtaacaatgtgtgttcgtactatttgcctaccatgttgagaaatgttggtatgaagagtgtctcattgaatgtgttaatgaatggtgtttattccatcgtcacttggatttcttcaatttgcggtgcattctttattgataagattggtagaagggaaggtttccttggttctatctcaggtgctgcattagcattgacaggtctatctatctgtactgctcgttatgagaagactaagaagaagagtgcttccaatggtgcattggtgttcatttatctctttggtggtatcttttcttttgctttcactccaatgcaatccatgtactcaacagaagtgtctacaaacttgacgagatctaaggcccaactcctcaactttgtggtttctggtgttgcccaatttgttaatcaatttgctactccaaaggcaatgaagaatatcaaatattggttctatgtgttctacgttttcttcgatattttcgaatttattgttatctacttcttcttcgttgaaactaagggtagaagcttagaagaattagaagttgtctttgaagctccaaacccaagaaaggcatccgttgatcaagcattcttggctcaagtcagggcaactttggtccaacgaaatgacgttagagttgcaaatgctcaaaatttgaaagagcaagagcctctaaagagcgatgctgatcatgtcgaaaagctttcagaggcagaatctgtttaa

SEQ ID NO: 166 - protein, 587 aa, Kluyveromyces marxianus var. lactis, Candida sphaerica
MADHSSSSSSLQKKPINTIEHKDTLGNDRDHKEALNSDNDNTSGLKINGVPIEDAREEVLLPGYLSKQYYKLYGLCFITYLCATMQGYDGALMGSIYTEDAYLKYYHLDINSSSGTGLVFSIFNVGQICGAFFVPLMDWKGRKPAILIGCLGVVIGAIISSLTTTKSALIGGRWFVAFFATIANAAAPTYCAEVAPAHLRGKVAGLYNTLWSVGSIVAAFSTYGTNKNFPNSSKAFKIPLYLQMMFPGLVCIFGWLIPESPRWLVGVGREEEAREFIIKYHLNGDRTHPLLDMEMAEIIESFHGTDLSNPLEMLDVRSLFRTRSDRYRAMLVILMAWFGQFSGNNVCSYYLPTMLRNVGMKSVSLNVLMNGVYSIVTWISSICGAFFIDKIGRREGFLGSISGAALALTGLSICTARYEKTKKKSASNGALVFIYLFGGIFSFAFTPMQSMYSTEVSTNLTRSKAQLLNFVVSGVAQFVNQFATPKAMKNIKYWFYVFYVFFDIFEFIVIYFFFVETKGRSLEELEVVFEAPNPRKASVDQAFLAQVRATLVQRNDVRVANAQNLKEQEPLKSDADHVEKLSEAESV

SEQ ID NO: 167 - DNA, 2655 bp, Saccharomyces cerevisiae
  CDS (1)..(2655)
atggatcctaatagtaacagttctagcgaaacattacgccaagagaaacagggtttcctagacaaagctcttcagagggtgaagggcatagcactgcgacgaaacaatagtaacaaagatcatacaacagatgatacgacaggtagcatacgaacccctacgagcttgcagcggcaaaattctgacaggcaatctaatatgacatccgtgtttacggatgacatttctaccatagacgacaactcaattttattttcagagcctcctcagaaacaatctatgatgatgtctatatgcgtaggtgtttttgttgcagttggcggatttttatttggttatgatacaggtctgatcaacagtattacatctatgaactatgtgaagtcacacgtagcacctaatcacgattcatttaccgcccaacaaatgtccattttggtgtcatttttgtcattgggaactttttttggggctttaactgcaccatttatatctgattcgtatggcaggaagcctactatcattttcagtacaattttcatcttctctatcggaaattctttacaggtaggtgctggaggaatcacattattgattgtgggaagggtcatttcaggtatcggtataggcgcaatttcagcggttgttccattataccaagcagaagctacacataaatcattaagaggtgctattatttctacttaccaatgggccattacctggggcttgctcgtgtcaagtgcagtgtcgcaagggacacacgcaagaaacgacgcatcttcgtatcggattcccatagggttgcaatatgtctggtcgtcatttctcgctatcgggatgttctttctccctgagagtccacgctattacgttttgaaagacaagctagatgaagcagctaaatctttatcgtttttaagaggtgtaccagtccatgattctgggttactggaagaactagttgaaataaaggcaacatatgattacgaggcatcttttggttcttcgaacttcattgattgttttatttcaagtaaaagtagaccaaagcaaactctaaggatgtttacgggaattgcccttcaagcatttcaacaattttcaggtatcaactttatattttactacggtgtcaatttcttcaataagacaggagtcagtaatagttatctggtttcatttataacctatgctgttaatgttgtctttaatgttcctggtttgttttttgtggaattttttggtagacgtaaggtgctggttgttgggggtgttatcatgactatagccaactttattgtggccattgttgggtgttccttaaagactgtagcggccgcaaaagttatgatagcatttatatgtctattcatagctgccttttctgctacatggggtggtgttgtttgggttatttcagcagaactgtacccattgggtgtgagatctaaatgtacggctatatgcgctgctgctaactggcttgtaaactttatttgtgctttaattaccccttatattgtagatactgggtcgcatacatcatcattaggtgcaaaaatattcttcatttggggctccttaaatgcgatgggggtgatagttgtttacttgaccgtttatgaaacgaagggtttgacattagaagagattgatgaattatatattaagtcatccactggtgtcgtgtcaccaaaatttaataaagatattagggaacgcgcacttaaattccaatacgatcctttgcaaagattagaagacggaaagaacacttttgttgctaaaagaaataattttgacgatgaaacaccaagaaatgattttcgaaatacgatatcgggcgaaatagatcatagtcccaatcaaaaagaagttcattctatcccagaacgtgttgatattcctactagtacagaaattcttgaaagcccgaacaaaagtagtggtatgacagtccctgtgtcaccttctctgcaagacgttccaatcccgcaaacaacagagcctgctgaaattcgaaccaaatatgtggacctaggaaatgggcttggtcttaatacgtataatagagggcctccctcactctcaagcgactcaagcgaagattacacagaagatgaaataggcgggccctcatctcaaggcgaccaaagtaatagaagtactatgaatgatattaatgattatatggcacgtctcattcacagtacttctactgcaagtaacacgacagataagttctccggtaaccaaagtacccttcgttaccacacggcttcctcacattcggatacaactgaagaggacagcaatttgatggacctgggaaacgggcttgccttgaatgcttataacagaggtccaccttcaattttaatgaattccagtgatgaagaggcaaatggtggtgagacgtctgataatttgaacacagctcaagacttggctggtatgaaggaacgaatggcgcagtttgcgcagagctatattgacaagagaggcggtctggaacctgaaactcaatctaatattttgagcacttctctctccgtgatggctgacactaatgaacataataatgaaatcctccactcaagcgaagaaaacgccactaatcaacctgtaaatgaaaataatgatttgaaataa

SEQ ID NO: 168 - protein, 884 aa, Saccharomyces cerevisiae
MDPNSNSSSETLRQEKQGFLDKALQRVKGIALRRNNSNKDHTTDDTTGSIRTPTSLQRQNSDRQSNMTSVFTDDISTIDDNSILFSEPPQKQSMMMSICVGVFVAVGGFLFGYDTGLINSITSMNYVKSHVAPNHDSFTAQQMSILVSFLSLGTFFGALTAPFISDSYGRKPTIIFSTIFIFSIGNSLQVGAGGITLLIVGRVISGIGIGAISAVVPLYQAEATHKSLRGAIISTYQWAITWGLLVSSAVSQGTHARNDASSYRIPIGLQYVWSSFLAIGMFFLPESPRYYVLKDKLDEAAKSLSFLRGVPVHDSGLLEELVEIKATYDYEASFGSSNFIDCFISSKSRPKQTLRMFTGIALQAFQQFSGINFIFYYGVNFFNKTGVSNSYLVSFITYAVNVVFNVPGLFFVEFFGRRKVLVVGGVIMTIANFIVAIVGCSLKTVAAAKVMIAFICLFIAAFSATWGGVVWVISAELYPLGVRSKCTAICAAANWLVNFICALITPYIVDTGSHTSSLGAKIFFIWGSLNAMGVIVVYLTVYETKGLTLEEIDELYIKSSTGVVSPKFNKDIRERALKFQYDPLQRLEDGKNTFVAKRNNFDDETPRNDFRNTISGEIDHSPNQKEVHSIPERVDIPTSTEILESPNKSSGMTVPVSPSLQDVPIPQTTEPAEIRTKYVDLGNGLGLNTYNRGPPSLSSDSSEDYTEDEIGGPSSQGDQSNRSTMNDINDYMARLIHSTSTASNTTDKFSGNQSTLRYHTASSHSDTTEEDSNLMDLGNGLALNAYNRGPPSILMNSSDEEANGGETSDNLNTAQDLAGMKERMAQFAQSYIDKRGGLEPETQSNILSTSLSVMADTNEHNNEILHSSEENATNQPVNENNDLK

SEQ ID NO: 169 - DNA, 1491 bp, Homo sapiens (man)
  CDS (1)..(1491)
atggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaa

SEQ ID NO: 170 - protein, 496 aa, Homo sapiens (man)
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 171 - DNA, 1770 bp, Arabidopsis thaliana (mouse-ear cress)
  CDS (108)..(1589)
agtaagacctaactcttaacgaacttttagataaaagcttataactgagagagacatagatcgacaaaagtctctataccttcttgtaacgtggtggttaattaatcatggccgatcaaatctccggcgagaagccggccggagttaatagattcgctcttcaatgtgctatcgtcgcctccatcgtctccatcatctttggttacgatactggtgttatgagtggagcgatggtgtttatagaagaagatttgaagacaaacgacgttcaaatagaagttctcactggaattctcaacctttgtgcccttgtcggatcattgctcgccggaagaacgtcggacataatcggacggcgttacacaatcgtcttggcctcaatactattcatgttaggctcaatattgatgggttggggtccgaattatccggttctcctatccggtagatgcaccgctggactcggagtcggttttgctctgatggttgctccggtttactctgccgagatcgcaactgcttcacatagaggactcttagcttctcttcctcacctttgtatcagtatagggattttactaggttatatcgtgaattacttcttctccaagttacctatgcatatcggttggagactcatgctcggtatagccgcggttccgtccctagtgctagcgttcgggatcttgaaaatgccggaatctccacggtggttgattatgcaaggccgtcttaaggaaggcaaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttagcatgatgaatataatgttatcattaaatgaaacgacagcgtttggggtttctcactcattacacgacgtcgtttagttgtacttttgtgtggcttttatcaaattataaatcaacggtcaagattgacgcacgctttagtatttttttcattaacaatttaagatcaacggctaatacatc

SEQ ID NO: 172 - protein, 493 aa, Arabidopsis thaliana (mouse-ear cress)
MADQISGEKPAGVNRFALQCAIVASIVSIIFGYDTGVMSGAMVFIEEDLKTNDVQIEVLTGILNLCALVGSLLAGRTSDIIGRRYTIVLASILFMLGSILMGWGPNYPVLLSGRCTAGLGVGFALMVAPVYSAEIATASHRGLLASLPHLCISIGILLGYIVNYFFSKLPMHIGWRLMLGIAAVPSLVLAFGILKMPESPRWLIMQGRLKEGKEILELVSNSPEEAELRFQDIKAAAGIDPKCVDDVVKMEGKKTHGEGVWKELILRPTPAVRRVLLTALGIHFFQHASGIEAVLLYGPRIFKKAGITTKDKLFLVTIGVGIMKTTFIFTATLLLDKVGRRKLLLTSVGGMVIALTMLGFGLTMAQNAGGKLAWALVLSIVAAYSFVAFFSIGLGPITWVYSSEVFPLKLRAQGASLGVAVNRVMNATVSMSFLSLTSAITTGGAFFMFAGVAAVAWNFFFFLLPETKGKSLEEIEALFQRDGDKVRGENGAA

SEQ ID NO: 173 - DNA, 1449 bp, Bacillus subtilis
  CDS (1)..(1449)
atgagtacaaaaaagaaagaggctgtaataggaaaagaaagcttagctcataaagggcttttacgaacgattacattggtatctacattcggcggcctgttgttcggttatgatacgggtgtcattaatggggcacttccttttatggcaactgcaggtcagctgaatcttacacctgttacagaaggactggttgcgagttccctgcttctcggggcagccttcggggcgatgtttggaggacgtctgtccgatcggcacggccgccgaaaaacgatcctttatttagccttactcttcatcgcagccacacttggctgtaccttttcaccaaacgcgtccgtgatgattgcctttcgttttctgcttggactggcggttggctgcgcttctgtaacggttccaacctttttagcggaaatttcgccggcagaacgcaggggacgaatcgtgacacaaaatgaactgatgatcgtaattggccagcttctggcatacacctttaacgccattattggcagcacaatgggggagagcgcaaatgtatggcggtatatgctggtcatcgcgacacttccggctgttgtgttatggttcggaatgctcatcgtgcctgaaagcccgcgctggctggcagctaaaggcagaatgggtgacgccctgcgggtgcttcggcaaatccgtgaagacagtcaggcacagcaggaaataaaagaaatcaaacatgcgattgagggcacagcaaaaaaggccggctttcatgattttcaagagccgtggataaggcgcattctattcattgggattggaatcgccatcgtacagcaaattaccggtgtcaattcgattatgtactatgggacagaaattctgagagaagccggttttcaaacagaagctgcattaatcggcaatattgcaaacggtgttatttcagttattgcggtcatttttgggatatggcttctcggcaaagtccgtcgccggcccatgctgatcatcggacagattggcacgatgacagcccttctgctgatcgggattttatccattgtccttgaaggaacacccgccctgccgtatgttgtgctgagtttgaccattttgtttcttgcgtttcagcagactgccatttctacggtgacgtggctgatgctctcggaaatctttcctatgcatgtgcgggggcttggcatggggatcagcaccttctgcttgtggacagctaactttctcattggattcacctttcccattttgctcaatcatattgggatgtcggcgacattttttatctttgtcgctatgaatatcctagcgattctatttgtgaaaaaatatgtgcctgagacaaaagggcggtcacttgaacagcttgagcattcctttcgccagtatggccgccgcgctgatcaggaaatccaaaatcaaacaactcacttatcgtaa

SEQ ID NO: 174 - protein, 482 aa, Bacillus subtilis
MSTKKKEAVIGKESLAHKGLLRTITLVSTFGGLLFGYDTGVINGALPFMATAGQLNLTPVTEGLVASSLLLGAAFGAMFGGRLSDRHGRRKTILYLALLFIAATLGCTFSPNASVMIAFRFLLGLAVGCASVTVPTFLAEISPAERRGRIVTQNELMIVIGQLLAYTFNAIIGSTMGESANVWRYMLVIATLPAVVLWFGMLIVPESPRWLAAKGRMGDALRVLRQIREDSQAQQEIKEIKHAIEGTAKKAGFHDFQEPWIRRILFIGIGIAIVQQITGVNSIMYYGTEILREAGFQTEAALIGNIANGVISVIAVIFGIWLLGKVRRRPMLIIGQIGTMTALLLIGILSIVLEGTPALPYVVLSLTILFLAFQQTAISTVTWLMLSEIFPMHVRGLGMGISTFCLWTANFLIGFTFPILLNHIGMSATFFIFVAMNILAILFVKKYVPETKGRSLEQLEHSFRQYGRRADQEIQNQTTHLS

SEQ ID NO: 175 - DNA, 1644 bp, Arabidopsis thaliana (mouse-ear cress)
  CDS (1)..(1644)
atgatgaagaatcttccggaggttggtaatggcggtggctcgggttttccggcggtctctgtcggaaataagaagaataagtatcagagaatggactccgacgcggaggaatcgcagaatcatcgtgaagcagaggctagaaacagtagaaccagaaaatacgttatggcttgtgccttttttgcatccttgaacaatgttcttctcggctacggtcggttttacttatataatcggattcttcttcttcttctttactttgttgacttacaaaaagatgttggggtaatgagcggtgcggtgttgttcatacagcaggatctcaaaataacggaggtgcagacggaagtgctcattggtagccttagcatcatctcactctttggcagcttagccggcggcagaacctctgactctatcggtagaaaatggaccatggccttggctgctctcgtcttccagactggtgctgccgtgatggctgtcgctccgtctttcgaggttttgatgatagggagaactttagccggcattgggattgggcttggtgtcatgatcgctcctgtctacatcgccgagatatcccccaccgtagctagaggatttttcacttcgttccctgagatcttcataaatctagggatcttgctgggctatgtttcgaactacgctttctcggggctttccgtgcatatcagctggaggatcatgcttgcagttgggattcttccttcggtgttcataggatttgcgctgtgtgtgatccctgagtcgccgaggtggctggtgatgaaaggccgagtggacagtgcacgagaggtgctcatgaaaacgaatgagcgagatgacgaagcggaagagcggcttgcagagatacaactggcggctgcacatacagaaggcagcgaggacaggcccgtgtggcgtgagcttcttagcccatctcctgttgtacggaaaatgctgattgttggatttggaatccagtgtttccagcagatcacaggaattgacgccacagtctactatagtccagagatcctgaaagaggctgggatacaagacgagaccaaactgctcgctgcaactgtcgctgttggtgtcacgaaaacagtgttcatactatttgccaccttcctgattgatagtgttggccggaaaccgctgctttatgtgagcacaataggaatgactctgtgtctcttttgtctaagctttacgctcacattcctcggccaaggaacgcttgggataaccttggcgcttctctttgtttgtggaaacgttgccttcttctccataggaatgggacctgtttgctgggtcttgacatcagagatctttccattacgattaagagcccaggcatctgcgcttggggcggttgggaacagggtgtgcagcggtctggtggccatgtccttcctctctgtgtcacgtgccatcactgttggaggaaccttcttcgttttctccctcgtgtctgcactctcagttatcttcgtgtatgtgctagtccccgagacaagcgggaagtcactggagcagatagagttgatgtttcagggtgggctggaaagaaaagacggtgaagttgagcttggagatgctgagcgtcttgtgcgcaaggaacaggagttttga

SEQ ID NO: 176 - protein, 547 aa, Arabidopsis thaliana (mouse-ear cress)
MMKNLPEVGNGGGSGFPAVSVGNKKNKYQRMDSDAEESQNHREAEARNSRTRKYVMACAFFASLNNVLLGYGRFYLYNRILLLLLYFVDLQKDVGVMSGAVLFIQQDLKITEVQTEVLIGSLSIISLFGSLAGGRTSDSIGRKWTMALAALVFQTGAAVMAVAPSFEVLMIGRTLAGIGIGLGVMIAPVYIAEISPTVARGFFTSFPEIFINLGILLGYVSNYAFSGLSVHISWRIMLAVGILPSVFIGFALCVIPESPRWLVMKGRVDSAREVLMKTNERDDEAEERLAEIQLAAAHTEGSEDRPVWRELLSPSPVVRKMLIVGFGIQCFQQITGIDATVYYSPEILKEAGIQDETKLLAATVAVGVTKTVFILFATFLIDSVGRKPLLYVSTIGMTLCLFCLSFTLTFLGQGTLGITLALLFVCGNVAFFSIGMGPVCWVLTSEIFPLRLRAQASALGAVGNRVCSGLVAMSFLSVSRAITVGGTFFVFSLVSALSVIFVYVLVPETSGKSLEQIELMFQGGLERKDGEVELGDAERLVRKEQEF

SEQ ID NO: 177 - DNA, 1395 bp, Bacillus subtilis
  CDS (1)..(1395)
atgaagaatactccaactcaattagaaccaaatgttcctgtaacaagaagccattcaatgggatttgtcattttgatctcatgtgcggcggggcttggcggcttattgtatggctatgacacggcagtgatttctggcgccatcggttttctgaaagatttatacagcctgagtccgtttatggagggacttgtcatttcaagcattatgattggaggagttgtgggcgtcgggatatccggatttttaagtgacagattcggccggagaaaaattttaatgacagccgctttgttatttgcgatatcagcaatcgtttcagcgctttctcaagacgtgtccaccttaatcattgcaaggattatcggggggctgggaatcgggatgggctcatcgctctctgttacgtatattacagaagcggcaccgcccgctatacgcggaagtttatcttcgttatatcagctctttacgatactgggtatttccgcaacatactttattaatctagctgtgcagcggtccggaacatacgaatggggcgtgcacaccggctggagatggatgcttgcttatggaatggtgccatccgtcatttttttccttgtcctgctcgtcgtcccggaaagtccgagatggctggcgaaagcgggcaaaacaaatgaagctttaaagatcctgacacgtattaatggagaaactgttgcaaaagaagaattaaagaacattgagaactctttaaaaatagaacaaatggggtcgctctcccagctgtttaagccgggtctcagaaaggcgcttgtcattggaatcctgctggcgctgtttaaccaagtcatcggcatgaacgcgattacttactacgggccggaaatctttaaaatgatgggattcgggcaaaacgccggatttgtgacgacttgtatcgtcggggttgtagaagttatttttaccgttattgcggtgttgctgattgataaagtcggacgaaaaaaactgatgtccatcggttctgcttttatggctatttttatgattttaatcgggacgtcgttttattttgagttaacaagcgggatcatgatgatcgtccttatattaggttttgtcgctgctttctgtgtctcggtcggaccgatcacatggattatgatttctgaaatcttcccgaaccatctgcgtgcgcgggccgcgggcattgcgaccatctttttatggggagcaaactgggcgatcggacagtttgtgccaatgatgatcgattctttcgggctcgcctatacattttggatctttgcggtgattaacatcctttgtttcctgtttgtcgttacgatctgtccagaaacgaagaacaaatcgctcgaggaaattgaaaagctttggataaaatga

SEQ ID NO: 178 - protein, 464 aa, Bacillus subtilis
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 179 - DNA, 1527 bp, Arabidopsis thaliana (mouse-ear cress)
  CDS (1)..(1527)
atggttcatgctgatggtcataattttcccggttcggatccaaaccctcatatgaacaagttcgctttcgggtgtgccattgttgcttccatcatttctatcatctttggatatgatacgggagttatgagcggagctcagatatttataagagatgatctaaaaataaacgacactcagattgaagttttggccggaatcttgaatctttgtgcactcgtcggatcactaacggcggggaaaacgtctgacgtcatcggccgacgttacaccatagctctctccgccgtgatattcttagtgggctcagttcttatgggttacggcccaaactatcctgttttgatggtcggacgatgtattgccggagttggtgtagggtttgctctcatgatagctccggtttactctgccgagatatcctctgcgtcacatagaggctttctcacttctctacctgagctttgtattagtcttgggattttactaggctatgtctcgaattactgttttgggaaactgacgttgaaacttggatggagattgatgcttggaatcgcagcgttcccgtctttgatattggcttttgggattacaagaatgcccgagtcgccgaggtggcttgtgatgcaaggtaggttagaagaagccaagaaaataatggttttggtatccaatacggaagaagaagctgaagaacggttcagagacatcttaaccgctgcggaagtagatgtgacagagataaaagaagttggtggcggcgttaagaagaagaatcacggtaaaagtgtttggagggagttggtgataaaaccgcgacctgcggtgcgtttgatcttgatagcggccgttgggatacactttttcgagcatgcgacggggattgaggccgtcgtgttgtacagcccgagaattttcaagaaagccggagttgtttcgaaagacaagctcttactagccacggtcggtgtaggtttaactaaggcctttttcataataatagccactttcttgctcgacaaggtaggtcgtagaaagctcctgttgaccagtacgggtgggatggtcttcgcattgaccagtttagcggttagtctcacgatggttcagcgatttgggcggttagcgtgggcattgagtttaagcatcgtctctacgtatgcatttgtagcttttttctccatagggcttggacctatcacatgggtgtacagctccgagatattcccgttgagacttagggctcagggagcgagtataggtgttgcggttaataggatcatgaacgcgacggtctcaatgagttttctgtcgatgacgaaggcgatcacgacagggggcgtgttcttcgtattcgccggaatagcggtggcggcatggtggttcttcttctttatgttgccggagacgaaaggattgccattggaggagatggagaagctttttggtggtgggggtcctcgtggtgatcgtgacggacttgagattcaaactaaaaccatctctattgggggtttctcataa

SEQ ID NO: 180 - protein, 508 aa, Arabidopsis thaliana (mouse-ear cress)
MVHADGHNFPGSDPNPHMNKFAFGCAIVASIISIIFGYDTGVMSGAQIFIRDDLKINDTQIEVLAGILNLCALVGSLTAGKTSDVIGRRYTIALSAVIFLVGSVLMGYGPNYPVLMVGRCIAGVGVGFALMIAPVYSAEISSASHRGFLTSLPELCISLGILLGYVSNYCFGKLTLKLGWRLMLGIAAFPSLILAFGITRMPESPRWLVMQGRLEEAKKIMVLVSNTEEEAEERFRDILTAAEVDVTEIKEVGGGVKKKNHGKSVWRELVIKPRPAVRLILIAAVGIHFFEHATGIEAVVLYSPRIFKKAGVVSKDKLLLATVGVGLTKAFFIIIATFLLDKVGRRKLLLTSTGGMVFALTSLAVSLTMVQRFGRLAWALSLSIVSTYAFVAFFSIGLGPITWVYSSEIFPLRLRAQGASIGVAVNRIMNATVSMSFLSMTKAITTGGVFFVFAGIAVAAWWFFFFMLPETKGLPLEEMEKLFGGGGPRGDRDGLEIQTKTISIGGFS

SEQ ID NO: 181 - DNA, 1566 bp, Arabidopsis thaliana (mouse-ear cress)
  CDS (1)..(1566)
atgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggtatataatgtttctagctttacctcttccaagctggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaa

SEQ ID NO: 182 - protein, 521 aa, Arabidopsis thaliana (mouse-ear cress)
MTLTIPNAPGSSGYLDMFPERRMSYFGNSYILGLTVTAGIGGLLFGYDTGVISGALLYIKDDFEVVKQSSFLQVYNVSSFTSSKLETIVSMALVGAMIGAAAGGWINDYYGRKKATLFADVVFAAGAIVMAAAPDPYVLISGRLLVGLGVGVASVTAPVYIAEASPSEVRGGLVSTNVLMITGGQFLSYLVNSAFTQVPGTWRWMLGVSGVPAVIQFILMLFMPESPRWLFMKNRKAEAIQVLARTYDISRLEDEIDHLSAAEEEEKQRKRTVGYLDVFRSKELRLAFLAGAGLQAFQQFTGINTVMYYSPTIVQMAGFHSNQLALFLSLIVAAMNAAGTVVGIYFIDHCGRKKLALSSLFGVIISLLILSVSFFKQSETSSDGGLYGWLAVLGLALYIVFFAPGMGPVPWTVNSEIYPQQYRGICGGMSATVNWISNLIVAQTFLTIAEAAGTGMTFLILAGIAVLAVIFVIVFVPETQGLTFSEVEQIWKERAYGNISGWGSSSDSNNMEGLLEQGSQS

SEQ ID NO: 183 - DNA, 1536 bp, Arabidopsis thaliana (mouse-ear cress)
  CDS (1)..(1536)
atgaattcctcgggagttgaacaaggtgttgtgattgcggagtcagagccaccgagggggaatagaagccgatatgcttttgcttgtgcaatcttagcctccatgacttctatcatccttggttacgacattggagtgatgagtggagcttcaattttcataaaagacgatttgaaactgtctgatgtacaacttgagattcttatgggaattctaaacatctactctctggtcggttccggcgcagctggtagaacttctgattggctcggaagacgatatacaatagtgttggcaggagccttcttcttttgcggagccctactaatgggctttgccacaaactaccctttcataatggttggccgttttgtagccggtatcggtgttggttatgctatgatgattgcgcctgtttacaccgctgaagtcgctcccgcctcttcccgaggcttccttacctctttccctgagatttttatcaatattggtatacttttgggatacgtatccaattacttcttctccaagcttcccgagcacctcggatggaggttcatgttaggtgtaggagcggttccctcggtgttcctagccattggagtgttggcaatgccggagtctcctcggtggctcgtccttcagggtcgtctcggggatgcttttaaagtccttgacaaaacctccaacaccaaagaagaagctatctctaggctcgatgacatcaaacgcgcagttggaatccccgatgatatgacagacgatgttatagtcgttccgaataaaaagagcgctggaaaaggcgtgtggaaggaccttctcgttcgaccaaccccgtccgttcgacacatcctcatagcatgccttggtattcatttcgcccagcaagcctctggaattgatgcggttgtgctttactctccgacaatcttctcaaaggctggactgaagtccaagaatgaccagctcttggctacggtcgctgtcggagttgtcaagactctcttcatcgtggtagggacttgtgtggtggatcggttcggacgtcgtgccttgttgcttacgagtatgggcggaatgtttctttccttgaccgcacttggaactagtctcacggtgatcaacaggaaccccgggcaaacactcaagtgggctatagggctcgccgttacgacggtgatgacttttgtggcaacattctcaataggtgcaggccccgtgacgtgggtctactgctcagagatattccctgtgaggctaagagctcaaggggcaagtttaggagtgatgttgaatagactaatgagtggtattattggaatgacattcctatctctttctaaaggtctcaccatcggcggtgcgttccttctattcgccggagttgctgccgccgcatgggtcttcttcttcactttcctcccggagacacgtggtatacctctagaggagatggagactctcttcgggagctacaccgcaaacaagaagaataattctatgagcaaagacaatgaagttgtggatggacaatga

SEQ ID NO: 184 - protein, 511 aa, Arabidopsis thaliana (mouse-ear cress)
MNSSGVEQGVVIAESEPPRGNRSRYAFACAILASMTSIILGYDIGVMSGASIFIKDDLKLSDVQLEILMGILNIYSLVGSGAAGRTSDWLGRRYTIVLAGAFFFCGALLMGFATNYPFIMVGRFVAGIGVGYAMMIAPVYTAEVAPASSRGFLTSFPEIFINIGILLGYVSNYFFSKLPEHLGWRFMLGVGAVPSVFLAIGVLAMPESPRWLVLQGRLGDAFKVLDKTSNTKEEAISRLDDIKRAVGIPDDMTDDVIVVPNKKSAGKGVWKDLLVRPTPSVRHILIACLGIHFAQQASGIDAVVLYSPTIFSKAGLKSKNDQLLATVAVGVVKTLFIVVGTCVVDRFGRRALLLTSMGGMFLSLTALGTSLTVINRNPGQTLKWAIGLAVTTVMTFVATFSIGAGPVTWVYCSEIFPVRLRAQGASLGVMLNRLMSGIIGMTFLSLSKGLTIGGAFLLFAGVAAAAWVFFFTFLPETRGIPLEEMETLFGSYTANKKNNSMSKDNEVVDGQ

SEQ ID NO: 185 - DNA, 1410 bp, Clostridium acetobutylicum
  CDS (1)..(1410)
atgggggaaaacaattcacataagcattctttattattcatagttctaatttcttgtgctgctggacttggtggcttattatatggatacgacactgcagtaatctctggtgctataggctttttaaagaagctttataatctttcacctgctatgcagggctttgttatttcaagtatcatggtcggtggtgtactaggcgttggtttttctggtttcttgggcgatgctattggtaggagaaaagttttaatgcttgctgctgcactatttgctatttccgctgtaatatcttctatatccacttctgcatttatgctcatttttgctcgtatagtaggaggtcttggtataggaatggcttctgccctatctgtaacatatataactgaatgtgcgccgccatctattcgcggtaggctgtcctcactttaccaactatttaccatacttggtatttcaattaccttctttgtaaacttgggaattgtaaatatgggcagcgaaacctggagagtttcaacaggttggagatatatgttagcttgtggaactgttccagccatagtattcttaattacattattctttgttccagaaagtcctcgttttcttgttaaatcaggaaatataaaaaaggctgctgctgttttaaccaaaatcaacggtgctgaaattgcaaagcaggaactagattccatttctaagtctcttgctaccgaaaacgattcttcattaggtcaacttcttcaacctggtcttagaagagctttattaattggtattttcttagctatatttaatcaagctattggaatgaattcaattacttattatggtcctgaaatatttcaaatgataggtttcaaaaataattctagctttcttgcaaccagtgttattggtgttgttgaagttttctcaacaattttagcaatgtttttaatagataaacttggacgtaaaaaattaatggaaataggatctgctgctatggcagtattcatgctattaatcggaacttctttctatataaaattatcaaatggttttgtaatattaatcttcataatatgttttgttgtttccttctgtatttcaatgggacctataccttggattatgattcctgaaatattccctaaccatttgagagctcgtgcaacaggcatagcaactatcttcctttggggtgctaactgggcaattggacaatttactccaatgcttttaaacggcattggtggagcatatactttttggatattctgtggaattaacgtaatatgcttcttagtagttacaactaaggttcctgagacaaaaaacaaaagtctggaagaaatagaaaagttttggattccaaaatcaaaacaaaatgccaaaggaagttcagtaggagcaaaataa

SEQ ID NO: 186 - protein, 469 aa, Clostridium acetobutylicum
MGENNSHKHSLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSKQNAKGSSVGAK

SEQ ID NO: 187 - DNA, 2234 bp, Saccharomyces cerevisiae
  CDS (1)..(1845)
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaagtgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttggacgttcggtcaacttttcgctgctggtattatgaaaaattcccagaacaaatatgccaactcagaactaggatataagctaccttttgctttgcagtggatctggccccttcctttggcggtaggtatttttttggcaccagagtctccatggtggctggttaaaaaaggaaggattgatcaggcgaggagatcacttgaaagaatattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttgtatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaatgccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcaccccatctgttgtgaacaaatgatttttttagccagtaggtagatacggcgttatttaattttattttatataactagtacttaacacatcgagtttatttttactcgacattatgacttttttttggttttgttgcggctttgaagttttttcaactagaggttattattttgttctgaaaaaacgttaatgatttaaatgaatcattgtgatgagggtcctaggtttaaatatcttgcaaaaagaagtactaatatacaattttttcattcccgttaatgaaaatgcttgaatctttatattgtatattgatacactctattcatgttccggcaacaattattttttttaattctgtaaatttactttttgacgtattctttcagcatttatatgcttatgttagaattc

SEQ ID NO: 188 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQVTGPSVDYMGNRYTLIMALFFLAAFIFILYFCKSLGMIAVGQALCGMPWGCFQCLTVSYASEICPLALRYYLTTYSNLCWTFGQLFAAGIMKNSQNKYANSELGYKLPFALQWIWPLPLAVGIFLAPESPWWLVKKGRIDQARRSLERILSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLGIAPVVFCLVSEMPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRSTPSVVNK

SEQ ID NO: 189 - DNA, 2890 bp, Saccharomyces cerevisiae
  CDS (818)..(2443)
aaaaagaaatattattcattactatcaagataccgtagaaaagaaaaagaaccggggatgaataataacaaaacgggctgctttttctttttctctttctttttcatttggtccctctccactctttctccacgtggctttgcttcccgtatttttcttcgtcagagagactacatgatagtccaaagaaaagaaacaggggggacgaagaagaggagaggaaaaaccaaaatataattttccgtgaaatagattctttttctccactgcacgacttcttctcctcccacaaaaaatgacgcctcatagacagccccgcagcttcacttttaagtttctttttctcctcacggcgcaaccgctaacttaagctaatccttatgaatccggagaaaagcggggtcttttaactcaataaaattttccgaaatcctttttcctacgcgttttcttcgggaactagataggtggctcttccacctgtttttccatcattttagtttttcgcaagccatgcgtgccttttcgtttttgcgatggcgaacgagggctggaaaaattaacggtacgccgcctaacgatagtaataggccacgcaactggcgtggacgacaacaataagtcgcccattttttatgttttcaaaacctagcaacccccaccaaacttgtcatcgttcccggattcacaaatgatataaaaagcgattacaattctacattctaaccagatttgagatttcctctttctcaattcctcttatattagattataagaacaacaaattaaattacaaaaagacttataaagcaacataatgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataagagattatacttaaactagcactgatttttttaaggctaatggctactaatactttaatagatgatcttcatacttttttatttaacgatttttaatgatgtttttatttgtaccactcatttatctagatttttttaatactgatcaaatcttacggactcgacgttaaaaagttcctacatacgtctggtacttgaaacgctgcttcgaggtattgacactataagaatacgatccaaatacttacaccgcatgtaaaaatatgccgacaatatgaatacttgttgatgaatgatatttgattttaatccggcaatttacctcctttatataatccaataattgttgataattagtggttaggttgcagtactaataagaattaagacaaatattcttctactatataaaaggtgcaaacaaaacacacgccgatcggccatact

SEQ ID NO: 190 - protein, 541 aa, Saccharomyces cerevisiae
MSEFATSRVESGSQQTSIHSTPIVQKLETDESPIQTKSEYTNAELPAKPIAAYWTVICLCLMIAFGGFVFGWDTGTISGFVNQTDFKRRFGQMKSDGTYYLSDVRTGLIVGIFNIGCAFGGLTLGRLGDMYGRRIGLMCVVLVYIVGIVIQIASSDKWYQYFIGRIISGMGVGGIAVLSPTLISETAPKHIRGTCVSFYQLMITLGIFLGYCTNYGTKDYSNSVQWRVPLGLNFAFAIFMIAGMLMVPESPRFLVEKGRYEDAKRSLAKSNKVTIEDPSIVAEMDTIMANVETERLAGNASWGELFSNKGAILPRVIMGIMIQSLQQLTGNNYFFYYGTTIFNAVGMKDSFQTSIVLGIVNFASTFVALYTVDKFGRRKCLLGGSASMAICFVIFSTVGVTSLYPNGKDQPSSKAAGNVMIVFTCLFIFFFAISWAPIAYVIVAESYPLRVKNRAMAIAVGANWIWGFLIGFFTPFITSAIGFSYGYVFMGCLVFSFFYVFFFVCETKGLTLEEVNEMYVEGVKPWKSGSWISKEKRVSEE

SEQ ID NO: 191 - DNA, 1602 bp, Emericella nidulans, Aspergillus nidulans
  CDS (1)..(1602)
atgtccatcctcgccttggtcgaagaccgcccaactccccgcgaggtttacaactggcgcgtctacctcctggccgcagtcgcctccttcacatcatgcatgatcggctacgacagcgccttcatcggcacaacgctgtctctgcaatcctttcaaaatgaatttaattgggaatcgctcaatacggatctcatcagcgcgaatatcgtctcgctatatcaacgaggtgccttcttcggcgctcttttcgcgtaccccatcggccacttctggggccgccgttggggtcttatgttctctgctcttattttcttccttggtgccggcatgatgctcggtgcgaatggggatcgagggctagggctgatctatggtggccgagtgcttgcgggcattggcgtcggcgccgggtcgaacatctgtcctatctacatctcagaaatggcaccctccgctattcggggtcgccttgttggggtttatgagctgggttggcagattggtggcgtcgttgggttctggatcaattacggcgtggacgaaacccttgccccaagccacaaacaatggatcatcccctttgccgtgcaattgattcctgctggcctgctcattatcggcgccctcttgatccgcgaatctcctcgttggctcttcctgcgcggtaaccgtgaaaagggcattgagaccctggcctggatccgcaacctgccagccgaccatatctatatggtcgaggaaatcaacatgatcgagcagtcgctcgaacaacagcgtgtcaaaattgggcttggtttctggaaaccctttaaagcagcctggacgaacaagcgtattctctaccgcctctttttggggtctatgttgttcctctggcagaacgggtcaggcatcaatgcgatcaactattacagcccgcgcgtcttcaagagtattggcgtatcgggtggcaatacctcactcttgacaacgggcattttcggtgtcgtcacggcggtcattacctttgtttggctgttgtatttgatcgatcattttggacgacggaacttgctgcttgttggtgcggcgggcggttcagtctgcctttggattgtgggcggatacatcaagatcgcgaagccagagaacaaccccgagggaacgcagcttgatagcggtggcattgcggctatattcttcttctacctgtggacggccttctatacaccatcttggaacggcacgccttgggtcatcaactcggaaatgttcgatcccaccgtccgctcccttgcacaagcctgtgctgccgcctcaaactggctctggaactttctgatctctcgctttacgccccagatgttcacgtccatgggatacggagtctacttcttctttgcatcgttgatgatcctctcgatcgtgtttgttttcttcctcattcccgagacgaagggcgtgccgctggagagcatggagactctatttgacaagaaaccggtttggcacgcccattcgcagctaatcagggagctgagggagaatgaggaggcgttccgggcggatatgggtgcgagtgggaagggaggtgtgacgaaggagtatgtcgaggaggcttaa

SEQ ID NO: 192 - protein, 533 aa, Emericella nidulans, Aspergillus nidulans
MSILALVEDRPTPREVYNWRVYLLAAVASFTSCMIGYDSAFIGTTLSLQSFQNEFNWESLNTDLISANIVSLYQRGAFFGALFAYPIGHFWGRRWGLMFSALIFFLGAGMMLGANGDRGLGLIYGGRVLAGIGVGAGSNICPIYISEMAPSAIRGRLVGVYELGWQIGGVVGFWINYGVDETLAPSHKQWIIPFAVQLIPAGLLIIGALLIRESPRWLFLRGNREKGIETLAWIRNLPADHIYMVEEINMIEQSLEQQRVKIGLGFWKPFKAAWTNKRILYRLFLGSMLFLWQNGSGINAINYYSPRVFKSIGVSGGNTSLLTTGIFGVVTAVITFVWLLYLIDHFGRRNLLLVGAAGGSVCLWIVGGYIKIAKPENNPEGTQLDSGGIAAIFFFYLWTAFYTPSWNGTPWVINSEMFDPTVRSLAQACAAASNWLWNFLISRFTPQMFTSMGYGVYFFFASLMILSIVFVFFLIPETKGVPLESMETLFDKKPVWHAHSQLIRELRENEEAFRADMGASGKGGVTKEYVEEA

SEQ ID NO: 193 - DNA, 1704 bp, Kluyveromyces marxianus var. lactis, Candida sphaerica
  CDS (1)..(1704)
atgtctaatcaaatgacagatagtacgagtgctggaagtggcactgaacattccgtcgacactaataccgcattaaaagccggtagtcccaatgaccttaaggtatcgcatgaagaggatttgaatgaccttgaaaagacagccgaagaaaccttacaacaaaagccagcaaaggaatacatatttgtttcattatgttgtgttatggttgcctttggtggtttcgttttcggttgggatactggtaccatttctggttttgttaaccaaactgatttccttagaagattcggtcaagaaaaggccgatggttctcactacttgtccaatgttagaactggtttgattgtttccattttcaatattggttgtgccgttggtggtattgttttgtctaacatcggtgatagatggggtcgtagaattggtttgattaccgttattataatctatgttattggtatcattattcaaattgcatctgtggacaaatggtaccaatatttcattggtagaattatttctggtttaggtgttggtggtatcacagttttgtcgccaatgttgatttcggaaaccgctcctaaacatttaagaggtactttggtctcatgttaccaattgatgattacttttggtattttcttgggttactgtactaactacggtaccaagaactactctaactctgtccaatggagagttccattaggtctatgtttcgcttgggccatctttatggttcttggtatgatgtttgttccagaatctgcaagattcttggttgaaactgatcaaattgaagaggccagaaaatctttggcaaagaccaacaaagtttctattgacgatcctgttgtgaaatatgagctcctaaagatccaatccagtatcgaattggaaaaggctgcaggtaacgcatcatggggtgaattgattaccggtaagccaagtatgttcagacgtactttaatgggtattatgattcaatctctgcaacaattgactggtgataactatttcttctattacggtaccacaattttccaatctgtcggtatggacgattctttcgaaacttcgatcgtcttgggtatcgtgaacttcgcttctaccttctttgctttatacacagttgatcatttcggtcgtcgtaactgtctattatacggttgtgttggtatggttgcatgttacgttgtttatgcatctgttggtgttacaagattatggccagacggtccagatcatcctgatatttcttccaagggtgctggtaactgtatgattgtctttgcgtgcttttatatcttctgtttcgctactacttgggctccaatcgcatacgtggttatctccgaatcctatccacttagagttaagggtaaggcaatggctatcgcttccgcctcgaactggatctggggtttcctgattgggttcttcacaccatttattacatctgctattcacttctactacggttacgtctttatgggttgtatggtattcgccttcttctacgtctacttcttcgttcctgaaaccaagggtctaactttggaagaagttaatgaaatgtactctgaaggtgtcctaccatggaaatcttcatcatgggtcccatcttcaagaagaggtgcagagtacgatgtcgatgctttgcaacatgacgacaagccatggtacaaggctatgttgtaa

SEQ ID NO: 194 - protein, 567 aa, Kluyveromyces marxianus var. lactis, Candida sphaerica
MSNQMTDSTSAGSGTEHSVDTNTALKAGSPNDLKVSHEEDLNDLEKTAEETLQQKPAKEYIFVSLCCVMVAFGGFVFGWDTGTISGFVNQTDFLRRFGQEKADGSHYLSNVRTGLIVSIFNIGCAVGGIVLSNIGDRWGRRIGLITVIIIYVIGIIIQIASVDKWYQYFIGRIISGLGVGGITVLSPMLISETAPKHLRGTLVSCYQLMITFGIFLGYCTNYGTKNYSNSVQWRVPLGLCFAWAIFMVLGMMFVPESARFLVETDQIEEARKSLAKTNKVSIDDPVVKYELLKIQSSIELEKAAGNASWGELITGKPSMFRRTLMGIMIQSLQQLTGDNYFFYYGTTIFQSVGMDDSFETSIVLGIVNFASTFFALYTVDHFGRRNCLLYGCVGMVACYVVYASVGVTRLWPDGPDHPDISSKGAGNCMIVFACFYIFCFATTWAPIAYVVISESYPLRVKGKAMAIASASNWIWGFLIGFFTPFITSAIHFYYGYVFMGCMVFAFFYVYFFVPETKGLTLEEVNEMYSEGVLPWKSSSWVPSSRRGAEYDVDALQHDDKPWYKAML

SEQ ID NO: 195 - DNA, 2211 bp, Saccharomyces cerevisiae
  CDS (508)..(2211): n means a or g or c or t/u, s means g or c
snnndnntcttagctatattcttccagcttcgcctgctgcccggtcatcgttcctgtcacgtagtttttccggattcgtccggctcatataataccgcaataaacacggaatatctcgttccgcggattcggttaaactctcggtcgcggattatcacagagaaagcttcgtggagaatttttccagattttccgctttccccgatgttggtatttccggaggtcattatactgaccgccattataatgactgtacaacgaccttctggagaaagaaacaactcaataacgatgtgggacattgggggcccactcaaaaaatctggggactatatccccagagaatttctccagaagagaagaaaagtcaaagttttttttcgcttgggggttgcatataaatacaggcgctgttttatcttcagcatgaatattccataattttacttaatagcttttcataaataatagaatcacaaacaaaatttacatctgagttaaacaatcatgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataa

SEQ ID NO: 196 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 197 - DNA, 2160 bp, Saccharomyces cerevisiae
  CDS (216)..(1928)
gaaactccaccattatctaatgtagcaaaatatttcttaacacccgaagttgcgtgtccccctcacgtttttaatcatttgaattagtatattgaaattatatataaaggcaacaatgtccccataatcaattccatctggggtctcatgttctttccccaccttaaaatctataaagatatcataatcgtcaactagttgatatacgtaaaatcatgaattcaactcccgatctaatatctcctcagaaatccaattcatccaactcatatgaattggaatctggtcgttcaaaggccatgaatactccagaaggtaaaaatgaaagttttcacgacaacttaagtgaaagtcaagtgcaacccgccgttgcccctccaaacaccggaaaaggtgtctacgtaacggtttctatctgttgtgttatggttgctttcggtggtttcatatttggatgggatactggtaccatttctggttttgttgctcaaactgattttctaagaagatttggtatgaagcaccacgacggtagtcattacttgtccaaggtgagaactggtttaattgtctctatttttaacattggttgtgccattggtggtatcgtcttagccaagctaggtgatatgtatggtcgtagaatcggtttgattgtcgttgtagtaatctacactatcggtatcattattcaaatagcctcgatcaacaagtggtaccaatatttcattggtagaattatctctggtttaggtgtcggtggtatcacagttttatctcccatgctaatatctgaggtcgcccccagtgaaatgagaggcaccttggtttcatgttaccaagtcatgattactttaggtattttcttaggttactgtaccaattttggtaccaagaattactcaaactctgtccaatggagagttccattaggtttgtgtttcgcctgggccttatttatgattggtggtatgatgtttgttcctgaatctccacgttatttggttgaagctggcagaatcgacgaagccagggcttctttagctaaagttaacaaatgcccacctgaccatccatacattcaatatgagttggaaactatcgaagccagtgtcgaagaaatgagagccgctggtactgcatcttggggcgaattattcactggtaaaccagccatgtttcaacgtactatgatgggtatcatgattcaatctctacaacaattaactggtgataactatttcttctactacggtaccattgttttccaggctgtcggtttaagtgactcttttgaaacttctattgtctttggtgtcgtcaacttcttctccacttgttgttctctgtacaccgttgaccgttttggccgtcgtaactgtttgatgtggggtgctgtcggtatggtctgctgttatgttgtctatgcctctgttggtgttaccagattatggccaaacggtcaagatcaaccatcttcaaagggtgctggtaactgtatgattgttttcgcatgtttctacattttctgtttcgctactacctgggccccaattgcttacgttgttatttcagaatgtttcccattaagagtcaaatccaagtgtatgtctattgccagtgctgctaactggatctggggtttcttgattagtttcttcaccccatttattactggtgccatcaacttctactacggttacgttttcatgggctgtatggttttcgcttacttttacgtctttttcttcgttccagaaactaaaggtttatcattagaagaagttaatgatatgtacgccgaaggtgttctaccatggaaatcagcttcctgggttccagtatccaagagaggcgctgactacaacgctgatgacctaatgcatgatgaccaaccattttacaagagtttgtttagcaggaaataaactaaacaagctcaatatgcatattttaatgacttatacagtatttaatttctcagtaaattttataaaggtgatattatattggtgttaaaacaaaattcttgtcaaattcataaacagatgttcttttctttgctagttcttgaccttcaccaaggaacaagaaatttcattctggcactcttccgaggaaaaattttatatgatatagtatgggttaataccacatagg

SEQ ID NO: 198 - protein, 570 aa, Saccharomyces cerevisiae
MNSTPDLISPQKSNSSNSYELESGRSKAMNTPEGKNESFHDNLSESQVQPAVAPPNTGKGVYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 199 - DNA, 2037 bp, Saccharomyces cerevisiae
  CDS (157)..(1869)
ctcgagaaaagacatatggtttgtaactatcttcttcttttttccaatttttctgttttaataataaaaaaacaagaacaaacaagctcaacttgtcttttctaagaacaaagaataaacacaaaaacaaaaagtttttttaattttaatcaaaaaatgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaaatcgaagctgtcttggctggtgtagaggcagagaaattagctggtaatgcatcctggggtgaattgtttagtagcaagacaaaggtccttcaacgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatctagaagaggtgccaactacgacgctgaagaaatggctcacgatgataagccattgtacaagagaatgttcagcaccaaataatttgcgaacatttttattaattcatgatcacgctctaatttgtgcatttgaaatgctctctaattctgattttatattttttaatgaacccttacgatttatattgtatggcaagatgttgccaatagaagtataattttttattaattttttttcttttctaagctt

SEQ ID NO: 200 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEIEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMAHDDKPLYKRMFSTK

SEQ ID NO: 201 - DNA, 3025 bp, Saccharomyces cerevisiae
  CDS (510)..(2288)
ctgcagttgatccgcattccccgtggctgtgcacattaggggacagtaagtaattcactttctgatcccgcactcatagcgatggaataatataccggatttcacaccttgttattgagtgaagtactgcttggtgaaatgatatctttatgttcaatattaatggtcgtgtggatgaatatatgggcatgggttaattagttttaggggcacggagtaaacaagaaaggagggccagaatcattagtagagtacctcaagtttggtttctttttgatttcacgtataaaagagtctctctcttttcttttcatgctagtcgaacggttctccctctaagaataagaaactatcaaaagaaagagaaaagtcgattgaataatttttctatatataatatacgcaaacaagattcgctttcactttgcaattttacttcatagctttgttaaaaccagcaaaaaatattatttttctagaaaaaagaatatattagaggtaaagaaagaatgtcggaacttgaaaacgctcatcaaggccccttggaagggtctgctactgtgagcacaaattctaactcatacaacgagaagtcaggaaactcgactgctcctggtaccgccggttacaacgataatttggcacaagctaaacccgtctcaagttacatttcccatgaaggccctcccaaagacgaactggaagagcttcagaaggaggttgacaaacaactagagaagaaatcgaagtcggatttactatttgtatccgtctgctgtttgatggttgcttttggtgggttcgtgtttgggtgggatactggtactatatctggttttgtcaggcaaacagacttcattaggcgatttggcagcacccgtgcaaacgggactacctatctttccgatgtcagaaccggtttgatggtttctattttcaacatcggctgcgctatcggaggtatagttttgtcaaagctcggtgatatgtatggacgtaagattggtctgatgactgttgtcgtcatttactcaattgggatcatcatccaaatcgcctccattgacaaatggtatcaatatttcattggaagaatcatctcaggactgggcgttggtggtattacagttttggcgcctatgctaatttctgaagtgtcgcctaagcagttgcgtggtactctggtttcatgttaccaattaatgatcactttcggtatctttttgggatattgtactaattttggtaccaagaattactcaaactctgtccaatggagggtaccattaggcttatgctttgcatggtctatttttatgattgttggtatgacgttcgttcctgaatccccacgttatctggtagaagtgggaaaaattgaagaggccaagcggtccttagcaagagctaacaaaaccactgaagactctcctttagtaactttagaaatggagaactatcagtcttctattgaagctgagagattggcgggctctgcttcttggggggaattggttactggtaagccccagatgttcagacgtacactaatgggtatgatgattcaatctttacaacagctgacaggtgacaattacttcttttactatggtactacaattttccaggctgttggtttggaagattcatttgaaactgctattgttttgggtgttgttaattttgtttcgacttttttctcgctatataccgtcgatcgttttggtcgtcgtaattgtttgttatggggctgtgtaggtatgatttgttgctatgtcgtctatgcctctgttggtgttaccagattatggccaaacggtcaagatcaaccatcttcaaagggtgctggtaactgtatgattgttttcgcatgtttctacattttctgtttcgctaccacttgggcccccgttgcctatgtccttatctctgagtcgtatcccttaagagtacgtggtaaagcaatgtcgattgcaagtgcctgtaactggatttgggggttcttgatcagttttttcactccatttattacttcagcaatcaatttctattatggctatgtctttatgggttgtatggtgttcgcatacttttatgtgttcttctttgttccagagacaaagggcttaacattagaagaagtcaacgaaatgtatgaagaaaatgtgctaccttggaagtctaccaaatggatcccaccatctaggagaacaacagattatgacctagacgctactagaaatgatccgagaccattttataaaaggatgttcactaaagaaaaataatctcttgtagtgtaggatcaactattttcgcatacttgcaatgttcagcattgcaccatttcaaattttaatattaatattaatcgttttcgttcatatgttcattcatagtttacaaataatgcaatcatatgcagagatattttgtccgtggttaatagggctgcctgttattcctttaattcaactaaattacgtatgtctaataatatcaaaatcatcatgacgtttttgttttttttctttattttaagtaggatcaaaccaggggagaaagggttgctacgcctaacaacaagaacttgtatatcgtttcttgttacttatacttttctgcccacttctctcttacaactgctcgagctcatccttggtaataaaacagtgaggacggttactcgaggtttcaacaggggaaaataaatttatatgatgaatcaagagccccgttcttttaccgtattatccttcatactacatactagggaaagaactgaaaactccgctacctgctgtaacagcgcataataaaaagcaagaatatagacagttactgttgtttacgttctttgatgacatcattctcatcagacatacagaaacacatcctttttgtctaccccgtatttattccaacttcaaagtataggtaccgtccggttatactctcatatactttgtggcagtttgcttctttaaaccttgttaacccagaatattttcagtgcaaaaagctt

SEQ ID NO: 202 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 203 - DNA, 1641 bp, Saccharomyces cerevisiae
  CDS (1)..(1641)
atggttagttcaagtgtttccattttggggactagcgccaaggcatccacttctctaagtagaaaggatgaaattaaactaacccctgaaacaagggaagctagcttggacattccatacaaacccattattgcatactggacggtgatgggtctctgtctgatgattgcctttggtggattcatttttggttgggatacaggaaccatttcagggtttattaaccaaacagatttcaagagaaggtttggtgagttacaaagggacggcagttttcaactatcagatgtcaggacagggctaattgtcggtatcttcaacataggttgtgctttaggtggcctaacgctgggacgcctgggcgatatttatgggcgtaaaatcggcttaatgtgtgttatactggtgtatgttgttggtatcgtgatccagattgcttcctctgacaaatggtatcaatattttattggtagaattgtttctggaatgggtgttggaggtgttgctgtgctgtcgccaactttgatctcagaaatttccccaaagcacctaagaggcacttgtgtctctttttaccagctaatgattacccttggaattttcttgggctactgtaccaattatggtacaaagaaatattcaaattcaatacagtggcgggttcccttgggtttgtgttttgcgtgggcaatctttatggtgattggaatggttatggttccggaatcgcccagatatttagtagaaaaaggtaagtatgaagaagctagaaggtctttggccaaatcaaacaaggtcacagttactgatccaggcgttgtttttgagtttgatactatagttgcaaatatggaattagaaagggctgttggaaatgccagttggcacgaactcttctcaaataaaggagcaattctaccaagggtaataatgggaatcgttatccagtcactgcaacagcttactggctgtaattattttttctactacggcacgaccattttcaatgctgttggaatgcaagactctttcgagacttccattgtccttggggctgttaattttgcttctacatttgttgcactatacattgtggataaatttgggcgtcgaaaatgtttattgtgggggtctgcctcgatggcaatttgtttcgtcatattcgccaccgttggcgtcactagattatggccacaagggaaagaccaaccttcttcgcaaagtgctggtaatgttatgatcgtttttacttgtttcttcattttctcttttgccattacttgggctcctatcgcctatgtcattgtggcagaaacttatccattaagagttaaaaatcgtgccatggccattgcggttggtgcgaactggatgtggggtttcttgattggatttttcacaccctttatcactagatccataggattttcttatggctatgttttcatgggttgcttaatcttttcgtacttctacgttttcttctttgtttgcgaaacaaagggattaactctggaggaagttaatgaaatgtacgaagaaagaataaagccatggaagtccggaggttggattcccagttctagaagaacaccacaaccaacaagcagtacaccattagttattgttgatagtaaataa

SEQ ID NO: 204 - protein, 546 aa, Saccharomyces cerevisiae
MVSSSVSILGTSAKASTSLSRKDEIKLTPETREASLDIPYKPIIAYWTVMGLCLMIAFGGFIFGWDTGTISGFINQTDFKRRFGELQRDGSFQLSDVRTGLIVGIFNIGCALGGLTLGRLGDIYGRKIGLMCVILVYVVGIVIQIASSDKWYQYFIGRIVSGMGVGGVAVLSPTLISEISPKHLRGTCVSFYQLMITLGIFLGYCTNYGTKKYSNSIQWRVPLGLCFAWAIFMVIGMVMVPESPRYLVEKGKYEEARRSLAKSNKVTVTDPGVVFEFDTIVANMELERAVGNASWHELFSNKGAILPRVIMGIVIQSLQQLTGCNYFFYYGTTIFNAVGMQDSFETSIVLGAVNFASTFVALYIVDKFGRRKCLLWGSASMAICFVIFATVGVTRLWPQGKDQPSSQSAGNVMIVFTCFFIFSFAITWAPIAYVIVAETYPLRVKNRAMAIAVGANWMWGFLIGFFTPFITRSIGFSYGYVFMGCLIFSYFYVFFFVCETKGLTLEEVNEMYEERIKPWKSGGWIPSSRRTPQPTSSTPLVIVDSK

SEQ ID NO: 205 - DNA, 1695 bp, Saccharomyces cerevisiae
  CDS (1)..(1695)
atgtctagtgcgcaatcctctattgatagcgatggagatgttcgagatgctgatattcatgtcgcaccacccgtggaaaaagagtggtcagatggatttgatgacaacgaagtcataaacggggataacgttgagccaccaaaaagagggctcataggttatcttgtcatttacttactgtgttatccaatatcctttgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggccttatttttgcccgtcttgctgatactttaggtagaaggctggcaattgtgatcgtggtgttggtatatatggttggtgcaattattcagatcagttcaaatcacaaatggtaccagtactttgtcggtaagatcatctacggtcttggtgctggtggctgttcggtgttgtgtccaatgcttttgtctgaaatagcccccacagatttgagaggtggactggtctcattgtaccaactgaacatgacgttcggtattttcttgggttattgtagcgtttatggtacgagaaaatacgataacactgcacaatggagagtcccccttgggctttgctttttatgggctttgattatcatcattggtatgttattggttccagagtccccaagatatctgattgaatgtgagagacacgaagaggcccgtgcttccattgccaaaatcaacaaggtttcaccagaggatccatgggtactcaaacaggctgatgaaatcaacgccggtgtccttgcccaaagggaactaggagaagcttcatggaaagaacttttctctgtaaaaactaaagtccttcaacgtttgatcacaggtattcttgtgcaaacctttttgcaacttactggtgaaaactacttcttcttctacggaactaccatttttaaatcagtcggtcttactgatgggtttgagacgtcgatcgtcctaggtacagtgaacttcttctccactattattgctgttatggtcgtagacaaaattggccgtcgtaaatgtctgttatttggtgcagctgggatgatggcttgtatggtcatatttgcaagtatcggggtgaaatgtctttaccctcatggccaggacggtccttcttcgaaaggtgcaggtaatgccatgattgtgttcacttgtttctatatattctgctttgcaacgacatgggctcctgttgcttatattgtggttgccgagtcgttcccttcgaaggtcaagtctagagccatgtcgatttcaactgcatgcaactggttatggcaatttttgatcggttttttcacaccattcattactgggtctatccacttctattatggttatgtgttcgtaggttgtttggttgctatgtttttgtacgttttcttctttttaccagaaacgattggtctatctttggaggaaatccaattactatacgaagaaggtataaaaccatggaaatctgcatcttgggtcccaccttctaggagaggtatttcttccgaagaaagtaagaccgagaagaaggattggaagaaatttttgaagttctcaaagaattctgattga

SEQ ID NO: 206 - protein, 564 aa, Saccharomyces cerevisiae
MSSAQSSIDSDGDVRDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWALIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGISSEESKTEKKDWKKFLKFSKNSD

SEQ ID NO: 207 - DNA, 3277 bp, Saccharomyces cerevisiae
  CDS (802)..(2505)
gaaaagaacaaagtaaatttaggatctggaaggagtgctgtatgtaaacgaagctttcagttttaggtaatgtttgcacaacctacatgatataagatggtatgttctgcaacagcgtgcctgtcacttggcccgttatagcagattataccatctgcaagcagaccccattattgcattgcctccgcagccttgcgtatacatagccctaagacaaaatacggagcgtaaacaaccctcgatccccgcaacaattacataaccatttctccgcggaattacataatcatttctccgggaaaattacataatcatttctccgtgcgagttataagtgcttttctcgtgcatttccctgacacttcacaaaaccttctttttcttttttctttatttcaggggaaatcagtgcaaaactaaaaagaaagaaattttgtgaaatgtaaactccaggtgtcaaaaaataaattatatccgtggaaaatcaggcgtcggaaattgtagatgaatccgcctcctccacaataaaaatgctgaccacacgagcaatgcatacactcggacaccttcgttcaaagtatcagtagcagttcgacacaccctatactacttagctcttaaggtctaggctcatctttctcagttcctctttttcgctaaataaaggtatataatgtcacagctgtgtaactaaagaacactgttgttcctatctttttcttcttctttttttggtatgagttggaaaaaataatcattgcacaattgagtactaaaagctttcgtatcttacccaatatcatgtccggtgttaataatacatccgcaaatgatttatccactaccgagtctaactctaactcagtagcaaatgcaccatctgtaaaaactgagcataatgactctaaaaactccctcaacctggatgccactgaaccacctattgacttacctcaaaaacccctctctgcatataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacaaatcagaggaaccctggtccaattgtaccagctgatgtgtacgatgggtatttttctaggatactgtaccaattacggtaccaagaactatcacaacgccactcaatggagagtcggccttggtctttgctttgcctggactacattcatggttagtggaatgatgtttgtaccagaatcaccacgttacctgattgaggttggtaaagatgaggaagcgaaacgttcactttcgaaatccaacaaagtctcagtcgacgatccagccttgttagcagaatatgacactataaaggcgggaatcgaacttgaaaagctggcaggtaacgcatcatggtctgaactactctccactaaaacaaaggtctttcagcgtgttctcatgggagtgatgatccaatcgctgcagcaattaaccggtgataactacttcttttactacggcaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcctgacgctggaggaggtgaatactatgtggctggaaggtgtgccagcatggaaatcagcctcatgggtgccaccagaaagaagaaccgcagattacgatgctgacgccatagaccatgacgatagaccaatctacaagaggttcttttccagctaatcttccggtttttagtaactggaaaaaaatacatgaacttaattatttattatatacaatatttacttttttacgccttaatccttaacggactatttgttatgccttatagaactagaaattatatgataaacatgagctacacgagttgacagggtgaacagattactatagcatctttctctcatgaataatttttaaaatgtataaattttgtaacgttccgaagggtggagtgaaattccattcaagaaaccaagcattgagacagaacagtacagagttcagttgttgcggaccgagaattgtaacaagtagccccagaaacattcatatgacgtctgtttcaaattaagcttagtaaaagtacacatttaccataaaaaaatagtaccaagtcggtggcctgatatccttattttccttctgccaattgggcaagttggtactaatattttaggtgacactgccactttattgttatggattgaaatttcttaaatgttctcacaatcggccataacgctatttctccgacgtaacctcctgtcatagtgtgccgtgcctgaataacttaaaaaattaaagttttcaatgtgcccaaaaaaattcacaaatagtacgcgctcgttaaacaccctgtgacgctgggccaggcactatttagcattacttcgaaaagacgcaagtataaagagtgagatctcacgtactacaacaagaacatagagaagcattctaataagcatataaacaaggcttctagagaaaa

SEQ ID NO: 208 - protein, 567 aa, Saccharomyces cerevisiae
MSGVNNTSANDLSTTESNSNSVANAPSVKTEHNDSKNSLNLDATEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKQIRGTLVQLYQLMCTMGIFLGYCTNYGTKNYHNATQWRVGLGLCFAWTTFMVSGMMFVPESPRYLIEVGKDEEAKRSLSKSNKVSVDDPALLAEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDDRPIYKRFFSS

SEQ ID NO: 209 - DNA, 1710 bp, Saccharomyces cerevisiae
  CDS (1)..(1710)
atgactgatcgtaaaaccaacttgccagaagaaccgattttcgaagaggcagaagatgatggctgcccttcgatagaaaattcttcacatctgtcagtacctacagtggaggaaaacaaggacttttccgagtataatggggaagaggcagaggaagttgttgttccagaaaagcctgcttcagcctatgctactgtttctatcatgtgtttatgtatggctttcggtggatttatgtccggttgggacacaggtacgatttctggtttcgtcaatcagactgattttttaagaagatttggtaattatagccattccaagaacacttactacttatctaatgtgagaactgggttgattgtgtccatcttcaatgtgggaagcgccattggctgtcttttcttgtctaaattgggtgatatttacggccgctgcatgggtttgattatagttattgtcgtttatatggttggtattgtcattcaaattgcctctatagataagtggtatcagtattttattggaagaattatcgctggtataggtgctggttccattagtgttcttgccccgatgcttatttcggaaactgcgccaaagcatatcagaggtacgttgctagcttgttggcaattgatggtgactttcgcaattttcttgggttattgtaccaattatggtaccaagacttactcgaattctgtccagtggcgtgttccgcttggtctatgttttgcatgggctattattatgattggtggtatgacgtttgttccggaatctcctcggtttttggtgcaagtcggtaagattgagcaagctaaagcttcttttgccaagtcgaacaagcttagtgttgacgatcctgctgtggttgcagagattgatcttcttgttgctggtgtggaggcagaagaagcaatgggaactgcttcatggaaggaattattttcgagaaagactaaagtttttcaacgtttaacgatgacagtcatgattaactctctgcagcaactaaccggtgacaactatttcttctactacggtactactatcttcaaatctgtcggtatgaatgactcttttgagacttcaattgtcttgggtattgtgaattttgcttcttgcttcttttcactttattctgttgataagttgggccgtcgtagatgtcttttacttggagcagccaccatgacggcgtgcatggttatttacgcctccgttggcgtcacaagactatatccgaacggtaaaagtgaaccatcatctaaaggtgctggtaattgtacgattgttttcacgtgtttttacattttctgcttttcctgcacctggggacctgtatgttatgtgattatttctgaaacatttccattaagggtgagatccaagtgtatgtccgttgcaacagcggccaacttattgtgggggttcctaatcgggtttttcactccttttattacttcggcaattaatttctactacggttacgttttcatgggttgcttagcgttttcatatttttacgtctttttctttgttccagaaacaaaaggtctaactttagaagaagttgatgagatgtggatggacggtgtattaccttggaaatctgaatcctgggtaccagcttctagaagggatggtgattatgataacgaaaaattacagcatgacgagaaacccttctacaaaagaatgttttag

SEQ ID NO: 210 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 211 - DNA, 1701 bp, Kluyveromyces marxianus var. lactis, Candida sphaerica
  CDS (1)..(1701)
atgtctgaattagagacaggaacagccgctcacggcactcctgtggagaacaagtctgtttccagttcgcaagcgtccactccaaccaatgtcggttccagagacgacttgaaggttgatgacgacaaccattctgttgacgccattgagcttccaaagaaaccacgttccgcttacatcaccgtttccatcttatgtttgatggttgcctttggtggtttcgttttcggttgggatactggtaccatttccggtttcgttaaccaaactgattttattagaagattcggtcaagaaaaggccgatggttctcactacttgtccaatgttagaactggtttgattgtttccattttcaatattggttgtgctatcggtggtattatcttgtccaagctaggtgacatgtacggtcgtcgtattggtttgatgattgttgtgttgatttacgttgttggtatcattattcaaattgcttccatcgacaaatggtaccaatacttcattggtagaattatctctggtctaggtgttggtggtatctctgtgttatccccaatgttgatttctgaaaccgctccaaaacatatcagaggtactttggtctctttctaccaattgatgattactttcggtattttcttgggttactgtactaactacggtaccaagacttactctaactctgttcaatggagagttccattaggtctatgtttcgcttgggccatctttatgatcactggtatgttgttcgttccagaatctccaagattcttggttgaaaaggacagaattgatgaggccaagagatccattgctaagtctaacaaggtttcctacgaagatccagctgttcaagctgaagtcgatttgatttgcgccggtgtcgaagctgaaagattggctggtagtgcttccatcaaagaattgttctctactaagaccaaggttttccaacgtttaatcatgggtatgttaatccaatctttccaacaattgactggtaacaattatttcttctactatggtaccaccattttcaactctgtcggtatggatgattctttcgaaacttccattgtcttgggtattgttaactttgcttctactttcgttgccatttatgtcgttgataagtttggtcgtcgtaaatgtttgttgtggggtgccgctgctatgactgcttgtatggttgtttttgcttctgtcggtgtcaccagattatggccagatggtgcaaaccatcctgaaactgcttccaagggtgctggtaactgtatgattgtcttcgcttgtttctacattttctgtttcgctacgtcgtgggctccaattgcttacgtcgtcgtcgctgaatcttacccattgagagttaaggctaagtgtatggctattgctactgcttccaactggatctggggtttccttaacggtttcttcacaccatttattacatctgctattcacttctactacggttacgtctttatgggttgtttggttgccatgttcttctacgtcttcttctttgttcctgaaactaagggtctaactttggaagaagtccaagaaatgtgggaagaaggtgtcctaccatggaaatcttcatcctgggtcccatcttccagaagaaacgctggttatgatgttgatgctttgcaacatgacgaaaagccatggtacaaggctatgttgtaa

SEQ ID NO: 212 - protein, 566 aa, Kluyveromyces marxianus var. lactis, Candida sphaerica
MSELETGTAAHGTPVENKSVSSSQASTPTNVGSRDDLKVDDDNHSVDAIELPKKPRSAYITVSILCLMVAFGGFVFGWDTGTISGFVNQTDFIRRFGQEKADGSHYLSNVRTGLIVSIFNIGCAIGGIILSKLGDMYGRRIGLMIVVLIYVVGIIIQIASIDKWYQYFIGRIISGLGVGGISVLSPMLISETAPKHIRGTLVSFYQLMITFGIFLGYCTNYGTKTYSNSVQWRVPLGLCFAWAIFMITGMLFVPESPRFLVEKDRIDEAKRSIAKSNKVSYEDPAVQAEVDLICAGVEAERLAGSASIKELFSTKTKVFQRLIMGMLIQSFQQLTGNNYFFYYGTTIFNSVGMDDSFETSIVLGIVNFASTFVAIYVVDKFGRRKCLLWGAAAMTACMVVFASVGVTRLWPDGANHPETASKGAGNCMIVFACFYIFCFATSWAPIAYVVVAESYPLRVKAKCMAIATASNWIWGFLNGFFTPFITSAIHFYYGYVFMGCLVAMFFYVFFFVPETKGLTLEEVQEMWEEGVLPWKSSSWVPSSRRNAGYDVDALQHDEKPWYKAML

SEQ ID NO: 213 - DNA, 1809 bp, Saccharomyces cerevisiae
  CDS (1)..(1809)
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaaccccccctaaagacgtctctcataacgaccccaagggagatatcgaagcttccattgcagaggaatag

SEQ ID NO: 214 - protein, 602 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPPKDVSHNDPKGDIEASIAEE

SEQ ID NO: 215 - DNA, 2064 bp, Saccharomyces cerevisiae
  CDS (290)..(1912)
aacgtgtctatgttgagcttcttaatatctacccagcaacctgtatatcagtgctttctttaattatacttcccttgacaaatcgatacgtcggccctcaaaagaagaggaaaaaaaatagaaaaaaaaatagaaaataaaaatgtcagtaattctaatgatgacacaaattcaaatagcaacattgaatactgtttaacagaacaattaaccacttttaattagaaatactaacaaagaatttgttaacgtattcttaggaagtaaagtacttcaattattgctagaaatgactgctcagattccgtatcaacatagctcgggatacatctctcattttcacaataatgagcttgatgcaggcaggggaagggattataatgtaaccattaagtatctagatgataaagaagaaaatatagaaggccaagcagcaaagattagtcacaatgcgagtctgcatattcccgttttattgtgcttggtaatctcgcttggtggctttatttttggatgggacattggaaccatcggtggaatgacaaatatggttagctttcaagaaaaatttggcacaactaatattatccatgacgatgaaacaatttttgtatctactaagaaacttactgatctgcaaataggcctaattatcagtatttttaacatcagttgtggcgtaggggctttaactctgtcaaaaatcggtgattggattggtaggaaaggtggtatatggtttgccttagtagtgtactgcatcggtataaccattcaaattctctcctatggaaggtggtattttttgacattgggaagagccgtaacgggaatcggtgtgggagtaaccactgtcttggtgccaatgtttctctccgagaattctccactaaaaatcagaggctccatggtatctacgtatcaattgattgtaacatttggcatactaatgggaaacattttaaatttcatatgcgaaagatgttataaagatcctacacaaaatatagcctggcaattgccattgttcttgggatacatttgggcaattataattggaatgtcacttgtttacgttcctgaatctccacagtacttggcaaaaatcaaaaatgatgtgccctctgctaaatactcttttgcgaggatgaatggcatccctgcgacggatagcatggtaattgaattcatcgatgatttgctggaaaataactataataatgaggaaactaacaacgaatcaaaaaagcaaagcttagttaaaagaaacacatttgaatttattatgggaaagccaaagttatggttgagactgattattggtatgatgataatggcatttcaacagctgtccggaataaattatttcttttattacggaacgtctgttttcaaaggtgtcgggattaaggatccttatattacttcaatcatactgtcaagtgttaacttcctttctacgatattaggcatatattacgtggagaaatggggccacaagacatgtttattatatggttcaacaaatttattattttatatgatgacatatgctactgtggggacatttggaagagaaacggacttctcaaatattgttttaattatcgtgacttgttgttttattttttggtttgcaataacattgggcccagttacatttgtactagtgtccgaattgttccctctaagaacgagggccatatcaatggctatttgcacatttatcaattggatgttcaatttcttaatatcacttttaacaccaatgattgtatccaaaattgatttcaaactaggatacatatttgctgcttgcctattagcgttgataatattcagttggatactagttcctgaaacgaggaaaaagaatgagcaagagatcaataaaatatttgaaccggagtagatattacataatataaatagaagaagtagcaaagtgcagtttttttttccataataaataaccatcagtaactaagtggccgtgaggactgaccacattttctttacatacagtaaagtaaataaatctatcaaatattttgattattactt

SEQ ID NO: 216 - protein, 540 aa, Saccharomyces cerevisiae
MTAQIPYQHSSGYISHFHNNELDAGRGRDYNVTIKYLDDKEENIEGQAAKISHNASLHIPVLLCLVISLGGFIFGWDIGTIGGMTNMVSFQEKFGTTNIIHDDETIFVSTKKLTDLQIGLIISIFNISCGVGALTLSKIGDWIGRKGGIWFALVVYCIGITIQILSYGRWYFLTLGRAVTGIGVGVTTVLVPMFLSENSPLKIRGSMVSTYQLIVTFGILMGNILNFICERCYKDPTQNIAWQLPLFLGYIWAIIIGMSLVYVPESPQYLAKIKNDVPSAKYSFARMNGIPATDSMVIEFIDDLLENNYNNEETNNESKKQSLVKRNTFEFIMGKPKLWLRLIIGMMIMAFQQLSGINYFFYYGTSVFKGVGIKDPYITSIILSSVNFLSTILGIYYVEKWGHKTCLLYGSTNLLFYMMTYATVGTFGRETDFSNIVLIIVTCCFIFWFAITLGPVTFVLVSELFPLRTRAISMAICTFINWMFNFLISLLTPMIVSKIDFKLGYIFAACLLALIIFSWILVPETRKKNEQEINKIFEPE

SEQ ID NO: 217 - DNA, 3323 bp, Saccharomyces cerevisiae
  CDS (1189)..(2883)
ttcgctgtttgttatctgttttgattttttttttcactgcttatcatacaaactgatcaattgagctatcaaacttcaacttatctctgtatttatatgctgaaagtatagagtgtacataaaaatgtatcacatgtctattacatattacgacacccccacaatattttaactgatcttaataacacggggtaggaagtttatttcatcataccactcaatgagctaagctgccaaaggctcctgttcacttccttgtggttcgtaggctattcagtggcaacgtaataaacaagaaaagaaaaaatttcaacacctttattctaaatgttgtcagaagtaattatagtgggggtattgcagatgtaaatgaaatacgacgtactgtggggggcttttctttttcaagaatcctaaactattccaatgggattgcgtgattatgtttcgttagagtttttttctatatctccgttcttatttcttaagtccgccccttgctgtaaccagcccggctattatttgacgaatttttcacatcttcattccttgccgagaaagaagcttttgcctccctggggttattataaaatatatctgacgtcactggtttgcagccaaaaagtttaattattttaacttcaagggttcgtttcggagtaaatagtcaatgcacaaaataggaaggtggaggtggggtatgcatttttgtgcatagagtggcggggtattaagaataatgcacatataggcacataggcacaaatgcgtgggatgacttgactgtgcaaagaccgttagcaacctagaatgtggaatagtatcccaaatgatgacgtaaacgttcgaggataatattagataatataatattagtatcctcgtctaaaaacaggcaaaatagcacggaatctattcaaaagaaggcggcaagcagtatcaattgagataagtgtatacgaacggtgaaacctccttggcacagaattttatcgttcaagtggtaggatagcattgctgccataacaccctccttaatcacaggataatatggtgaacgagatatataaagcgataagtttaggtgtgatatttttctttcgttgtgcaagtgttgtgtaaattctttctcatttgataaatcaaaaaaaaaaaaaaaaaaaagaaaagaaaagaaaaattaataaaatgcaatcatccactgaaagtgatagagatattcaggatggtcctgatgctgatattcacgtcgcaccacccgtggaaaaagagtggtcagatggatttgatgacaacgaagtcataaacggggataacgttgagccaccaaaaagagggctcataggttatcttgtcatttacttattgtgttatccaatatccttcgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggtcttatttttgcccgtcttgctgatactttaggtagaaggctggcaattgtaatcgtggtgttggtatatatggttggtgcaattattcagatcagttcgaatcacaaatggtaccaatacttcgttggtaagattatctatggtcttggtgctggtggctgttcggtgttgtgtccaatgcttttgtctgaaatagctcctacagatttgagaggtggacttgtctcattgtaccaacttaacatgaccttcggtattttcttgggttattgtagcgtttatggtacgagaaaatacgataacactgcacaatggagagtcccacttgggctttgctttttatggactttgattatcatcattggtatgttattggttccagagtccccaagatatcttattgaatgtgagagacacgaagaggcccgtgcttccattgccaaaatcaacaaggtttcaccagaggatccatgggtactcaaacaggctgatgaaatcaacgccggtgtccttgcccaaagagaactaggagaagcttcatggaaagaacttttctccgtcaaaactaaagtccttcaacgtttgatcacaggtattcttgtgcaaacctttttgcaacttactggtgaaaactactttttcttctacggaactaccattttcaaatcagtcggtcttactgatgggtttgagacgtcgatcgttctaggtacagtgaacttcttttccactattattgctgttatggtcgtagacaaaattggccgtcgtaaatgtcttttatttggtgcagctgggatgatggcttgtatggtcatatttgcaagtatcggggtgaaatgtctttaccctcatggccaggatggtccatcctcaaaaggtgcaggtaatgccatgattgtgttcacttgcttctatatattttgctttgcaacgacatgggctcctgttgcttatattgtggttgccgagtcgttcccttcgaaggtcaaatctagggccatgtcgatttcgactgcatgcaactggttgtggcaatttttgatcgggtttttcacaccattcattactgggtctatccacttctattatggttatgtgttcgtaggttgtttggttgcaatgtttctgtacgttttcttctttttaccagaaacgattggtctatctttggaggaaatccaattactatatgaagaaggtataaaaccatggaaatctgcatcttgggtcccaccttctaggagaggtattccttccgaagaaagtaagaccgagaagaaggattggaagaaatttttgaagttctcaaagggttctgattgatcatagagtgcatatgcttgtcttgataggcaacattgtatattatattttacataataatgtgtaattctaatttgtcacgaatttatgaagattcttggagctatgaagatcaacatatgtagaaactggtatgtgtcataggtaaaaagtattcattaagacaaaattgtgtctaattcttagtcatttattcaattttttttttttttttttacgtaaagcggggtggagtgacatgatatggtgatggtgatgagaaactctaaatggatccatttgactatcgattgaaaatcatgaaagatgcgcttgaaggaacataacacgttactatttgtctaaataaaacaatatacaaaaatacgacattatatatactctacccaagatatttagtcattactatcgagggcgcgtagatcagatcacctttaaaa

SEQ ID NO: 218 - protein, 564 aa, Saccharomyces cerevisiae
MQSSTESDRDIQDGPDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWTLIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGIPSEESKTEKKDWKKFLKFSKGSD

SEQ ID NO: 219 - DNA, 3143 bp, Saccharomyces cerevisiae
  CDS (962)..(2686)
gctcttgtgtctttgttatatgggtacaagatataagaaacataactattacatacgaaaatgtgcatgttatctatatccttctttatatagatgctgttaacttctttttttttttttgggaaaatcaactgttaaacgcgacagtaaaagcagcaaaacattaattttgcttccaagacgacagtaatatgtctcctacaataccagtttcgctgcagaaggcacatctattacatttactgagcataacgggctgtactaatccaaggaggtttacggaccaggggaactttccagattcagatcacagcaatataggactagaaaatatcaggtagccgcactcaacttgtaactggcaactactttgcatcaaactccaattaaatgcggtagaatcttttcacaaaaggtactcaacgtcaattcggaaagcttccttccggaatggcttaagtaggttgcaatttctttttctattagtagctaaaaatgggtcacgtgatctatattcgaaaggggcggttgcctcaggaaggcaccggcggtctttcgtccgtgcggagatatctgcgccgttcaggggtccatgtgccttggacgatattaaggcagaaggcagtatcggggcggatcactccgaaccgagattagttaagcccttcccatctcaagatggggagcaaatggcattatactcctgctagaaagttaactgtgcacatattcttaaattatacaacattctggagagctattgttcaaaaaacaaacatttcgcaggctaaaatgtggagataggataagttttgtagacatatataaacaatcagtaattggattgaaaatttggtgttgtgaattgctcttcattatgcaccttattcaattatcatcaagaatagtaatagttaagtaaacacaagattaacataataaaaaaaataattctttcataatggcagttgaggagaacaatatgcctgttgtttcacagcaaccccaagctggtgaagacgtgatctcttcactcagtaaagattcccatttaagcgcacaatctcaaaagtattctaatgatgaattgaaagccggtgagtcagggtctgaaggctcccaaagtgttcctatagagatacccaagaagcccatgtctgaatatgttaccgtttccttgctttgtttgtgtgttgccttcggcggcttcatgtttggctgggataccggtactatttctgggtttgttgtccaaacagactttttgagaaggtttggtatgaaacataaggatggtacccactatttgtcaaacgtcagaacaggtttaatcgtcgccattttcaatattggctgtgcctttggtggtattatactttccaaaggtggagatatgtatggccgtaaaaagggtctttcgattgtcgtctcggtttatatagttggtattatcattcaaattgcctctatcaacaagtggtaccaatatttcattggtagaatcatatctggtttgggtgtcggcggcatcgccgtcttatgtcctatgttgatctctgaaattgctccaaagcacttgagaggcacactagtttcttgttatcagctgatgattactgcaggtatctttttgggctactgtactaattacggtacaaagagctattcgaactcagttcaatggagagttccattagggctatgtttcgcttggtcattatttatgattggcgctttgacgttagttcctgaatccccacgttatttatgtgaggtgaataaggtagaagacgccaagcgttccattgctaagtctaacaaggtgtcaccagaggatcctgccgtccaggcagagttagatctgatcatggccggtatagaagctgaaaaactggctggcaatgcgtcctggggggaattattttccaccaagaccaaagtatttcaacgtttgttgatgggtgtgtttgttcaaatgttccaacaattaaccggtaacaattattttttctactacggtaccgttattttcaagtcagttggcctggatgattcctttgaaacatccattgtcattggtgtagtcaactttgcctccactttctttagtttgtggactgtcgaaaacttgggacatcgtaaatgtttacttttgggcgctgccactatgatggcttgtatggtcatctacgcctctgttggtgttactagattatatcctcacggtaaaagccagccatcttctaaaggtgccggtaactgtatgattgtctttacctgtttttatattttctgttatgccacaacctgggcgccagttgcctgggtcatcacagcagaatcattcccactgagagtcaagtcgaaatgtatggcgttggcctctgcttccaattgggtatgggggttcttgattgcatttttcaccccattcatcacatctgccattaacttctactacggttatgtcttcatgggctgtttggttgccatgtttttttatgtctttttctttgttccagaaactaaaggcctatcgttagaagaaattcaagaattatgggaagaaggtgttttaccttggaaatctgaaggctggattccttcatccagaagaggtaataattacgatttagaggatttacaacatgacgacaaaccgtggtacaaggccatgctagaataatgcgtttgaagtgagacgctccatcatctctcttaatttttcatgactgacgttttttcttcattttaattatcatagtatttgtttgaaaaaaaaaaaaaaaaatttcccttatcaatgatatccttacgattatataaattccttacctaaacctattatttgtgtacatatatcagagtattattacatatataacctttttctctaaaacaggaaaaaaaaaagaaaacgataacatgctctgccatcctttgttcaccgagcaaaattaaaaacgcaaaatgaattgtccctatgaaattattaaaggaccacatcaccagacttatctctggggggtcctctagaaaataagtcaggtacttgcctggactttcttccagttgaattcctgagctaacatacaattaatggagtgagaatgttcgaacgatccaggagttgcttttttcag

SEQ ID NO: 220 - protein, 574 aa, Saccharomyces cerevisiae
MAVEENNMPVVSQQPQAGEDVISSLSKDSHLSAQSQKYSNDELKAGESGSEGSQSVPIEIPKKPMSEYVTVSLLCLCVAFGGFMFGWDTGTISGFVVQTDFLRRFGMKHKDGTHYLSNVRTGLIVAIFNIGCAFGGIILSKGGDMYGRKKGLSIVVSVYIVGIIIQIASINKWYQYFIGRIISGLGVGGIAVLCPMLISEIAPKHLRGTLVSCYQLMITAGIFLGYCTNYGTKSYSNSVQWRVPLGLCFAWSLFMIGALTLVPESPRYLCEVNKVEDAKRSIAKSNKVSPEDPAVQAELDLIMAGIEAEKLAGNASWGELFSTKTKVFQRLLMGVFVQMFQQLTGNNYFFYYGTVIFKSVGLDDSFETSIVIGVVNFASTFFSLWTVENLGHRKCLLLGAATMMACMVIYASVGVTRLYPHGKSQPSSKGAGNCMIVFTCFYIFCYATTWAPVAWVITAESFPLRVKSKCMALASASNWVWGFLIAFFTPFITSAINFYYGYVFMGCLVAMFFYVFFFVPETKGLSLEEIQELWEEGVLPWKSEGWIPSSRRGNNYDLEDLQHDDKPWYKAMLE

SEQ ID NO: 221 - DNA, 4409 bp, Saccharomyces cerevisiae
  CDS (1233)..(3524)
tagctgaaaaatcgcggtactgaagcttttttcatggcgcccttgaaactttctccttccgcctgcgcattatataaaatacgttacaataggaaaagatgacagttacttaaagtaaagcttcacagcttcagacaaaaaaagtatgaaacttgtgaagatgtttttatgctgatccggcagacggccattccattatttagttctgattttagtggaaaaactttcgaaacttaaaataataatagcccattcttggactgaggtacattttcttcttattggatttcgtttattagctgtttaacatatttctgtagggtttttttttttttttttgtacagattagaaaccatacagtgtaaaccattatataggtcaattaatatatttatagatcatcctgtcaatttttttttatttttttttgcaaagctccctttttcctgaaaccaacaacaaaatataaaaaaaaaatgataagcaggattttttcttttaataattccttaaaattaactaacaagctgaagcccttacaacaaagtaagtcaaacccaattcacaaaaaaaaaatctgttttatttcagatatgcagggtatatacatggcacagataaccttttaatgaaaagtagcaattgtgatactagcgcctttttccttgcaagaaaagggttccctgttcctgcatcgtccatcggcatagagatgtcgccgctaccctatccaattctaccgcatgcctaacaaaatgatttccgattttttcaatctaactccgtcatttcttatctgagttttcctccccgagataaattgaacaaagaatttaatcggctcatatgtgaaaaagtgtgatacttaccgcaatgggcaaaaattattaaaaaaaatctaattccgcgcttggctattatctcattaccgactcaacggtgactacctgccgtacacgcttcccctttgcttcttcctccacctcgaaagtagaacatatacatggaacagacataagctcttcagcgtatctatttcataagtggagagcatcgaacaataaacctttgcctaatttcatataacatccagtattcattttttttagttgacgctaaggcattcgcttgtgaaattaaagagcagatcaggaatagtatcaatagtctaaaccatcaagttgcacagaaaccactatatatatatggaaatatctcgaatattgcttgtatgaacgatagccaaaactgcctacgacagagggaagaaaatagtcatctgaatcctggaaatgacttcggccaccaccagggtgcagaatgtacgataaatcataacaacatgccacaccgcaatgcatacacagaatctacgaatgacacggaagcaaagtccatagtgatgtgcgacgatcctaacgcataccaaatttcctacacaaataatgagccggcgggagatggagctatagaaaccacgtccattctactatcgcaaccgctgccgctgcgatcgaatgtgatgtctgtcttggtaggcatatttgttgccgtggggggcttcttgtttgggtatgacactggacttataaacagtatcacggatatgccgtatgttaaaacctacattgctccgaaccattcatatttcaccactagccaaatagccatactcgtatcattcctctccctaggaacatttttcggtgcgttaatcgctccctatatttcagattcatatggtaggaagccaacaattatgtttagtaccgctgttatcttttccatcggaaactcattacaggtggcatccggtggcttggtgctattaatcgtcggaagagtgatctcaggtatcgggatcgggataatctctgctgtggttcctctttatcaagctgaagctgcgcagaagaaccttagaggtgccatcatttccagttatcagtgggctatcactattgggttactcgtgtccagtgcagtatcgcaaggaactcattccaaaaatggcccgtcttcatatagaataccaattggtttgcagtacgtttggtcaagtattttagctgtgggcatgatattccttccagagagtccaagatattacgtcttgaaggatgaactcaataaagctgcaaaatcgttatcctttttaagaggcctcccgatcgaagatccaagactcttagaggagcttgttgaaataaaagccacttacgattatgaagcatcgttcggcccgtcaacacttttagattgtttcaaaacaagtgaaaatagacccaaacagattttacgaatatttactggtatcgccatacaagcttttcaacaggcatctggtatcaattttatattctactatggagttaattttttcaacaacacaggggtggacaactcttacttggtttcttttatcagctatgccgtcaacgtcgccttcagtataccgggtatgtatttagtggatcgaattggtagaagaccagtccttcttgctggaggtgtcataatggcaatagcaaatttagtcattgccatcgttggtgtttccgagggaaaaactgttgttgctagtaaaattatgattgcttttatatgccttttcattgctgcattttcggcgacatggggtggtgtcgtgtgggtggtatctgctgaactgtacccacttggtgtcagatcgaaatgtaccgccatatgcgctgccgcaaattggctagttaatttcacctgtgccctgattacaccttacattgttgatgtcggatcacacacttcttcaatggggcccaaaatattcttcatttggggcggcttaaatgtcgtggccgttatcgttgtttatttcgctgtttatgaaacgaggggattgactttggaagagattgacgagttatttagaaaggccccaaatagcgtcatttctagcaaatggaacaaaaaaataaggaaaaggtgcttagcctttcccatttcacaacaaatagagatgaaaactaatatcaagaacgctggaaagttggacaacaacaacagtccaattgtacaggatgacagccacaacataatcgatgtggatggattcttggagaaccaaatacagtccaatgatcatatgattgcggcggataaaggaagtggctcgttagtaaacatcatcgatactgcccccctaacatctacagagtttaaacccgtggaacatccgccagtaaattacgtcgacttggggaatggtttgggtctgaatacatacaatagaggtcctccttctatcatttctgactctactgatgagttctatgaggaaaatgactcttcttattacaataacaacactgaacgaaatggagctaacagcgtcaatacatatatggctcaactaatcaatagctcatctactacaagcaacgacacatcgttctctccatcacacaatagcaatgcaagaacgtcctctaattggacgagtgacctcgctagtaagcacagccaatacacttccccccaataaaaaccaatagcatcttacgatcgttcgaggtcttataaaccgttttatataaattattcttatacacgcactcttgagtttcttttaacattccaacatgatagacatagaaaagaattatagataacacataacattactcacaagtagcccatgagtttgatttttcctcgttaattcggtgtcaagtggaatacaaaatgggtcaactgatcataactattacccggataatctacatcatgtggtacgttaacgatgtatggtttcctaaatcaccgggttccagatgcgggttgttgttgttcgatcttgcacctccacgtactccttttgaatagtacacatataccttacaggagatcggacgtgtgcgattattgttacctcgtcacctgttatcggttgaactgttttagctctttccattccctttgttaatagtagtttaattcttcggaaactttctacgcagactcaagttgcaataggctaaagataaggcagacactttgtatgtaacgagtttcattaggagggatagacgcacgacactatctggtactacgtgttatatcatacccagaaggaaggactctctccactgaacggtgggatgagttcctaaaggcgcccctttatttgatcaggaagccgtattgattatctaatagggcctagttatcctaattgtggggagtcgagcagtacggctctgatgtttttcgaacgaagataaggagttgacatacaaagtcaacagaagttcttcttgttagcgtctctgtgctcaatatctctctttttttctttaagtagtaattactaacatcagccaaccaatagagataaaaaaaaaaggaattaagatttcatagagaaaag

SEQ ID NO: 222 - protein, 763 aa, Saccharomyces cerevisiae
MNDSQNCLRQREENSHLNPGNDFGHHQGAECTINHNNMPHRNAYTESTNDTEAKSIVMCDDPNAYQISYTNNEPAGDGAIETTSILLSQPLPLRSNVMSVLVGIFVAVGGFLFGYDTGLINSITDMPYVKTYIAPNHSYFTTSQIAILVSFLSLGTFFGALIAPYISDSYGRKPTIMFSTAVIFSIGNSLQVASGGLVLLIVGRVISGIGIGIISAVVPLYQAEAAQKNLRGAIISSYQWAITIGLLVSSAVSQGTHSKNGPSSYRIPIGLQYVWSSILAVGMIFLPESPRYYVLKDELNKAAKSLSFLRGLPIEDPRLLEELVEIKATYDYEASFGPSTLLDCFKTSENRPKQILRIFTGIAIQAFQQASGINFIFYYGVNFFNNTGVDNSYLVSFISYAVNVAFSIPGMYLVDRIGRRPVLLAGGVIMAIANLVIAIVGVSEGKTVVASKIMIAFICLFIAAFSATWGGVVWVVSAELYPLGVRSKCTAICAAANWLVNFTCALITPYIVDVGSHTSSMGPKIFFIWGGLNVVAVIVVYFAVYETRGLTLEEIDELFRKAPNSVISSKWNKKIRKRCLAFPISQQIEMKTNIKNAGKLDNNNSPIVQDDSHNIIDVDGFLENQIQSNDHMIAADKGSGSLVNIIDTAPLTSTEFKPVEHPPVNYVDLGNGLGLNTYNRGPPSIISDSTDEFYEENDSSYYNNNTERNGANSVNTYMAQLINSSSTTSNDTSFSPSHNSNARTSSNWTSDLASKHSQYTSPQ

SEQ ID NO: 223 - DNA, 1704 bp, Saccharomyces cerevisiae
  CDS (1)..(1704)
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcaacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaatccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 224 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 225 - DNA, 1830 bp, Saccharomyces cerevisiae
  CDS (1)..(1830)
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaacccccctaaagacgtctctcataacgaccccaagggagatatcgaagcttccattgcagaggaatagcaatgtatcccatcacctatga

SEQ ID NO: 226 - protein, 609 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPLKTSLITTPREISKLPLQRNSNVSHHL

SEQ ID NO: 227 - DNA, 1710 bp, Saccharomyces cerevisiae
  CDS (1)..(1710)
atgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcaccggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggttga

SEQ ID NO: 228 - protein, 569 aa, Saccharomyces cerevisiae
MKDLKLSNFKGKFISRTSHWGLTGKKLRYFITIASMTGFSLFGYDQGLMASLITGKQFNYEFPATKENGDHDRHATVVQGATTSCYELGCFAGSLFVMFCGERIGRKPLILMGSVITIIGAVISTCAFRGYWALGQFIIGRVVTGVGTGLNTSTIPVWQSEMSKAENRGLLVNLEGSTIAFGTMIAYWIDFGLSYTNSSVQWRFPVSMQIVFALFLLAFMIKLPESPRWLISQSRTEEARYLVGTLDDADPNDEEVITEVAMLHDAVNRTKHEKHSLSSLFSRGRSQNLQRALIAASTQFFQQFTGCNAAIYYSTVLFNKTIKLDYRLSMIIGGVFATIYALSTIGSFFLIEKLGRRKLFLLGATGQAVSFTITFACLVKENKENARGAAVGLFLFITFFGLSLLSLPWIYPPEIASMKVRASTNAFSTCTNWLCNFAVVMFTPIFIGQSGWGCYLFFAVMNYLYIPVIFFFYPETAGRSLEEIDIIFAKAYEDGTQPWRVANHLPKLSLQEVEDHANALGSYDDEMEKEDFGEDRVEDTYNQINGDNSSSSSNIKNEDTVNDKANFEG

SEQ ID NO: 229 - DNA, 2020 bp, Beta vulgaris (beet)
  CDS (190)..(1662)
tttttaaaaaaaaagaagagaaaagcacgtagaaggcaccaaacaaacattacaatttacagtacagctgcaaaaattagctgaggcgaagagaagactgagtagtgactggttgaaaacacccaaaagactaagaagtgctgacactttgccactttgttttgattgttgacaccccaaaaaaaaaaaatgagttcagattcagaagcaggtttaggaggaggaggaggagatctgcggaaaccatttttgcatacaggaagttggtatagaatgggttccagacaatcaagtttgatgggttcttctcaagttattcgagaaagctccatctctgtccttgcttgtgttcttattgttgctcttggtcctattcagtttggttttactgctggttattcatctccaactcaatcagcaattacaaatgaacttggtctttctgttgcagagtactcatggtttggttctctatccaatgtgggtgccatggttggggcaattgcaagtggtcaaatatctgagtatattggaagaaaagggtctttgatgattgctgctatccccaacataattggatggcttgctatatcatttgccaaagattcttcatttctgtatatgggaaggatgttggaaggttttggcgtgggaataatatcttacacggttcctgtgtacatttctgaaatagcaccacagaatttgaggggagctttgggttcagtaaaccagctatccgttacaatcggtataatgctatcgtatatgctggggctttttgtcccgtggaggatacttgcagttttaggaattttaccatgcactatattgatacctggcttattcttcataccggaatctcctaggtggttggcgaaaatgggtatgatggaagaatttgaggtttccttgcaagttctccggggctttgacactgatatatctcttgaagttaatgaaatcaagagatctgttgcttcaagtagcaaaagaaccaccataagatttgcagaactacgacaaagaagatattggttacccttgatgatagggaatggtttacttattttgcaacaactcagtggaatcaatggtgtcctgttctattctagtaccatctttaaagaggctggggtcacatcaagcaacgctgcaacatttggccttggtgctgttcaggttatcgcaactgttgtgactacctggttggtggataaatcaggacgcagacttcttctaattgtctcttcttctgggatgacattgagtcttctagtggtcgcaatgtccttctttttaaaggaaatggtatcagacgaatctacatggtacagtgtattctccatcctttcagttgttggagttgtggctatggtggttactttctcactaggaattggagcaattccgtggattataatgtcagagattcttccaattaacatcaaggggctggctggaagtattgctacacttgccaactggtttgtagcatggattgtgacaatgactgcaaacataatgttgtcatggaatagtggaggtactttctctatttacatggttgtttgtgctttcactgtggcctttgtggtcatttgggtccccgagacaaaggggagaacattggaggagattcagtggtccttcagaagataaagaattttctgataacttgtccatggtgtcgtgcagtgggctagattcagtccaagctaacatttacagcttggtggatctagcaatgctgggtagataatgtacattcgaggtgtatcttttatcataagaggactcttgccttatggaagaattgtgcattacaacagagcttccccctcaaccccttcatttatttttgtttatattgtcccatttcctttacccgttgccagccaaaagctgttaagattcattatattttaggacaacagttgcaccaatgttcgtagaacttgacattgattgggtttatagttcaatttgttattgccatgtaaaaaaaaaaaaaaaaaaa

SEQ ID NO: 230 - protein, 490 aa, Beta vulgaris (beet)
MSSDSEAGLGGGGGDLRKPFLHTGSWYRMGSRQSSLMGSSQVIRESSISVLACVLIVALGPIQFGFTAGYSSPTQSAITNELGLSVAEYSWFGSLSNVGAMVGAIASGQISEYIGRKGSLMIAAIPNIIGWLAISFAKDSSFLYMGRMLEGFGVGIISYTVPVYISEIAPQNLRGALGSVNQLSVTIGIMLSYMLGLFVPWRILAVLGILPCTILIPGLFFIPESPRWLAKMGMMEEFEVSLQVLRGFDTDISLEVNEIKRSVASSSKRTTIRFAELRQRRYWLPLMIGNGLLILQQLSGINGVLFYSSTIFKEAGVTSSNAATFGLGAVQVIATVVTTWLVDKSGRRLLLIVSSSGMTLSLLVVAMSFFLKEMVSDESTWYSVFSILSVVGVVAMVVTFSLGIGAIPWIIMSEILPINIKGLAGSIATLANWFVAWIVTMTANIMLSWNSGGTFSIYMVVCAFTVAFVVIWVPETKGRTLEEIQWSFRR

SEQ ID NO: 231 - DNA, 2340 bp, Schizosaccharomyces pombe
  CDS (55)..(1722)
actctttttcatccttttttgctaatattctcctgatctttgaattcgttaaatatgaataggtttattacatcaattctcgtggtgtttatctcaatgtccggatggttgcaaggcgccgatactggttccattagcggcatcttgggcatgcgagattttcaatctcgttttgctgatcgttacaatcccatttcaaattcctacagttactcagcatggagacaagctttgttgactggtacaatcaatgctggctgtttatttggtgctatgctttcttcgccgtttaccgaaagaattggtaagaaatactctatttgctttttcagcggggtatatattattgcagagcttcttttagtcacagcagtcccttcttggattcaagtattggttggtaaaatccttgctggtgttggtatcggagctttgtcagtcttgagtcctggataccaatctgaagtagcaccaccacaaattcgtggtgcagttgttgcaacctatcaaattttctcgacaggtgctgctttagttgcagcctgtatcaatatgggaactcataaactgcgtaagactgcatcatggagaacttcttttggcataaatatgctttggggaatcctgttaatggttggtgtactctttttgcctgaatcaccgcgttatcttatttacaaaggacgagatgaagaagctcttcgaattatgtgcaatatggcggaactaagtcctgaaagtgaaattattcaaactaattttaataccattaagagtgatattgaaatagaaatggctggaggtaaagcaagatggatagaaattttcggtaaggatattcgataccgtacctgcttaggatttcttgtcatgttgttcagagagttgattggtaacaattattatttctattatgctacacaagttttcaagggaactggtatgacggatatattcttaccagccgttattttaggtgctattaattttggtacaacgtttggtgctttatacacaattgataacttaggacgtcgtaacccactaatttttggagctgctttccaatcgatatgcttctttatatatgccgctgtaggcgatcgaaagctcatatataagaatggtactagtgatcacagagcaggatctgtaatgattgtgttttcttgtttgtttcttttctcttactgctgttcttggggcccaatgggctgggtaattgtgggtgaaacttttcccattcgttatcgcagtaaatgcgcttctgtagccacatcgggaaactggctgggtaatttcatgatttctttttttactcctttcattaacaatgcgatcggattcaagcttggttacatttacgcctgcattaatttgtttagttcatttatgattttctttttggctaaagaaactaaaggtcttactttggaggaagtcaatgacttatacatgtccaacattaagccatgggaatcttacaaatatgtaagagaaattgaatctcatcgtatacactttagtaaagaagaagaaaagcgtgaaagagagaaatcgaaaggtattcgcggccaagaagaagaattcattgaaaatgctgatgaagacaataacgatagtagttcttcttcaggatctgtcgtgtctgctgtcaagccacggagatccgctgtttccaacgatcgcttttcagaggattcacaccctacgtatatctaaacaaattttaaaattaaaattctaaatgttcctgtatttctttacatttattttgtttttatattgatagcgaggcagttctagatttattatcatgaggccgaatattctaaattttaaaaaatgaataagagctttgaaatttctgtttttgtattgtttaatgaaatattgttgctatgattttctaattttgaggtatttgtttgttattcgaagtatggcaattagtatttatccctgtgatgcgaaatgataccaaatttccagtattttttttaaaatccttcctattcataataattttttctctacataacgttgtcgttaatatattgttaaaaaaaattttttaaggcgcaaagaagtaatgcatacattggaaattcaaaacttacagaaagtccttctaagtagaaagaaaccgcattgccccattaagatgtaaagcagtttaaaagattaccaatgatttatgtaaagttaaaaacaatactttctttttagtggtagaaggaatgagctcctcctcttttttttactacccaagggagggcgatcacttgtgaatttttttctcaaaactaaacttatttagagtaccatttgataaaaatt

SEQ ID NO: 232 - protein, 555 aa, Schizosaccharomyces pombe
MNRFITSILVVFISMSGWLQGADTGSISGILGMRDFQSRFADRYNPISNSYSYSAWRQALLTGTINAGCLFGAMLSSPFTERIGKKYSICFFSGVYIIAELLLVTAVPSWIQVLVGKILAGVGIGALSVLSPGYQSEVAPPQIRGAVVATYQIFSTGAALVAACINMGTHKLRKTASWRTSFGINMLWGILLMVGVLFLPESPRYLIYKGRDEEALRIMCNMAELSPESEIIQTNFNTIKSDIEIEMAGGKARWIEIFGKDIRYRTCLGFLVMLFRELIGNNYYFYYATQVFKGTGMTDIFLPAVILGAINFGTTFGALYTIDNLGRRNPLIFGAAFQSICFFIYAAVGDRKLIYKNGTSDHRAGSVMIVFSCLFLFSYCCSWGPMGWVIVGETFPIRYRSKCASVATSGNWLGNFMISFFTPFINNAIGFKLGYIYACINLFSSFMIFFLAKETKGLTLEEVNDLYMSNIKPWESYKYVREIESHRIHFSKEEEKREREKSKGIRGQEEEFIENADEDNNDSSSSSGSVVSAVKPRRSAVSNDRFSEDSHPTYI

SEQ ID NO: 233 - DNA, 1674 bp, Schizosaccharomyces pombe
  CDS (1)..(1674)
atggatttcaacaatattccccttgcgaccattaagtccagcgatgataagggtaaagactttatcgtggaaatgaccactcgtccttctgaaaccaagaagaaggttcctttttctgaggacatgcgtgaaatcccttctttaccgaacgaggaagaagcgaatgcaacggatccacaagccaacgaggtcgctgatgaaaacggtgaaggatttgaagctgaaaaaatcagtagttggatttgggtgctgtcggctgttgcaggtatttctggtttgctgttcggttatgacactggtgttatttcaggcgctctcgctgtcctcggtagcgatcttggtcacgtccttagctctggccaaaaagaattgattacctctgccacttccttcgccgcccttatatctgcaaccacttcaggatggcttgctgattgggtcggtcgcaaacggcttttgctatgtgcagatgcaatttttgtcatcggatctgttattatggctgcttcgcggaatgttgcaatgatggttgttggtcgttttattgtaggttatggaattggtcttacttctcttattgtcccaatgtatattactgagttggctcctgctcgtttgcgcggacgacttgtcatcatttacgtggtcttcattaccggtgggcagctgattgcctactcacttaatgctgcttttgaacatgtacatcaaggttggagaattatgtttggaattggtgcggcccccgccttaggtcagcttatttcgcttttctggactccggagtctccaaggtatttgcttagacataaccatgttgaaaaagtctacaagattttgtctcgaatccatcccgaagcaaagccagctgaaattgcatataaagtctcattgattcaagagggcgtcaaagttgattttcctgaagggaataagtttcaacatttctttcattctttaaaagtacttttcacggttccttcaaatagaagatccctttttattggttgcttccttcaatggttccaacaattttctggcactaatgcaattcaatatttctctgcaatcattttccaaagtgttggatttaaaaattctatctctgtcagtattgttgtcggtgctactaactttgttttcacaatagtcgcattcatgtttattgaccgtattggaagaagacgaattttgctttgtacttcagccgtgatgattgcaggtttggcgctttgtgcaatcgcttatcattttcttcctgcagacaccacccaaaacacaaacagtggttggcaatatgtcgtattagcatccatcattattttccttgctagctatgcttctggaatcggaaatattccctggcaacaagccgaattgtttcctatggaagtcagagcccttggtgctggattctcaactgctatcaactgggttggaaatctcatcattagtgcttcctttttgacaatgatggagtctatcacaccaacgggtacatttgcattgtttgctggattttgttttgttggactcgtgacaagctactttacttatcccgaacttgcaggaatgtctattgaaaatatacacaagctgcttgaaaaaggtttttggcaagctgtaaaggaaagtactaaacgcgttagaaaaggaagaatagatgaagcttga

SEQ ID NO: 234 - protein, 557 aa, Schizosaccharomyces pombe
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 235 - DNA, 1596 bp, Schizosaccharomyces pombe
  CDS (1)..(1596)
atggggttcaagcgtggaaagaattttacccttgttatgttaattttcgtctccatggccggttggatgtttggtgctgataccggttccattggtggtgttactagtatgcgcgattttcgtgagcgttatgctgatagatatgacccgatcaccgaccagtattctttgtcttcggctcgtcaaggtcttttaactggtatggttaacgttggttccttgtttggatgtatcatttcttctcccattgccgatcgttttggtaagagactttctatcattggtttttgtgctgtttatatcattggtatcatcgttcaagttaccgctgttccctcttgggtacaaatcatggttgccaagatttggactggtattggtattggcgctctttctgtcttggctcctggatatcaatcagagactgctcctcccagtattcgtggtaccgtcgtcgtcacttatcagttgtttgtcactggtggaattttcattgccgcttgtatcaatatgggtactcacaaacttcataaaactgcccagtggcgtgtttcaattggtattaatctcctttggggtatcattaccatgattggaattctcttccttcccgaatcccctcgttatcttattcaagttggcaaggatgaagaggctgttagagttctttctgaaagtgctgagctttttcctgatagtgaggaagttcaaaatgaatatcaccgtctcaaatcatctattgacgaagaatttgctggtggcccttgcagctgggcaagcattttcggtaaagacattcgttatcgtactttccttggtatgtttgttatgtcgcttcaacaattgaccggtaacaactatttcttctactatggtttctcagttatgcaaggagctggtattaattctccttacctatctgctatgattcttgatgcagttaattttggctgcacttttggtggtatgtatgtattggaaaggtttggtcgtcgtaaccctcttatcattggtggtatttggcagtcaatttgctttttcatttattcagctgtcggttctcgtgctttatatcataagaacggtacttcaaatacccgtgctggtgccgttatgattgtcatggcatgtcttttcatttttggatttgctcaaacttgggctcctgccgcatacgttattgttggtgagtcataccctgttcgttaccgctctaagtgtgctgccgtcgctactgctagcaactggctctggaatttcctaatttcattctttactccattcattcaagcttctattggattcaagtacggttacgtttttgcttcttgtaatttgaccggtgcaattgttattttcttgtttgctaaagagactaaaggtcttactttggaagaaattaatgagttgtatatgtctgtcatcaagccctgggaatctggtaactttaagcttaactattctgagcaaaagaaagttgagaaagagaaatccagaaagggcggtgcccgtggtgagtctgttgagtatgttgagcgtgcttcaaacactgactcatctccacaatactcttcccatgaggaagattacgcataa

SEQ ID NO: 236 - protein, 531 aa, Schizosaccharomyces pombe
MGFKRGKNFTLVMLIFVSMAGWMFGADTGSIGGVTSMRDFRERYADRYDPITDQYSLSSARQGLLTGMVNVGSLFGCIISSPIADRFGKRLSIIGFCAVYIIGIIVQVTAVPSWVQIMVAKIWTGIGIGALSVLAPGYQSETAPPSIRGTVVVTYQLFVTGGIFIAACINMGTHKLHKTAQWRVSIGINLLWGIITMIGILFLPESPRYLIQVGKDEEAVRVLSESAELFPDSEEVQNEYHRLKSSIDEEFAGGPCSWASIFGKDIRYRTFLGMFVMSLQQLTGNNYFFYYGFSVMQGAGINSPYLSAMILDAVNFGCTFGGMYVLERFGRRNPLIIGGIWQSICFFIYSAVGSRALYHKNGTSNTRAGAVMIVMACLFIFGFAQTWAPAAYVIVGESYPVRYRSKCAAVATASNWLWNFLISFFTPFIQASIGFKYGYVFASCNLTGAIVIFLFAKETKGLTLEEINELYMSVIKPWESGNFKLNYSEQKKVEKEKSRKGGARGESVEYVERASNTDSSPQYSSHEEDYA

SEQ ID NO: 237 - DNA, 1800 bp, Schizosaccharomyces pombe
  CDS (50)..(1657)
tttggtcattactttttctttttaaaaaaactagcatttattaagaacaatggcgaaaatcttaaccattgtcatgttggtcttcgtgtccatggccggatggatgttcggtgctgacacgggttccattggtggtatcactaatatgcgggactttcaatctcgatacgcagacaggtatgatcctgtcacagatacgtattcgtattcttctgctcgccaaggtcttttggttggtatggttaacactggaactactgttggatgtttactttcttcacctcttggagatcgattcggtaaacgtaagtgtatcatgggatggacattggtttacattaccggtgttatcgttcaactcaccacaattccatcttgggttcaaatgatggtagctaaaatttggactggtcttggcattggtgctttgtcagtcattgctcctggttaccaatccgaatcttctcccccccatattcgtggtgccattgtaactacttatcaattgttcattactcttggtatttttattgccgcctgtatcaacatgggtactcacaaatacaccactcatcctgaagctcaatggcgtgttcccatcggtattaacttactttggggtattctcatgttctttggaatgcttttcctccctgaatccccacgttaccttgcagttaaaggaagaaatgaagaatgtatgaaaattcttactcgtaatgctggcctcccagccgatcatcccatcatgcaaaaagaatacaatgccattcaagctgacgttgaggcagaattggctggtggtccttgctcctggcctcagatctttagcaacgaaattcgttacagaacacttttgggaatgggtgtcatggcattccaacaattgaccggtaacaattacttcttctactatggtactcaggtattccgcggtactggcttgaactcccccttcctcgcagctttgattcttgatgctgtcaactttggatgtacgtttggtgctatctttgttcttgaatactttggtcgtcgtggtcccctcatcgttggtggtgtttggcaatctatttgtttctttatttatgcttctgtaggtgatcgtgcacttacccgccccaatggtacttcgaatcatcgtgctggtgccgttatgattgtgttctcatgtcttttcattttcagttttgctcaaacttgggctcctgccgcatacgttatcgttggtgaatcgtatcccattcgttatcgttccaagtgtgctgccgtcgctactgctagcaactggttctggaactttatgatttccttcttcactccctttattagcaactcaattggtttcaagtatggttatgtgtttgcagcttgcaacttgtgtgccgctattattattttcctattcgccaaggaaaccaaaggtcttaccttggaagagattaaccaactttatttgtcgaatattaagccctggaacactggtgcttaccagcgtgatcgggaagatattaagcaaagcgactcagaaaaggagcgtggacctacttctaagttacatgaatacgttgagcatgctcccaactcgtatgcttcaacacactctacagagagtgagaattatcctcaacaagtcaccaatccggttggcttatgaaactagtgagggaattcaattcttgatggctttatgaatcaagcacactagatagaggatttcaagtcccaatatgaagacacttagattttaagtccagataaaattggatttccgccgaaaagccacctcaactttttaca

SEQ ID NO: 238 - protein, 535 aa, Schizosaccharomyces pombe
MAKILTIVMLVFVSMAGWMFGADTGSIGGITNMRDFQSRYADRYDPVTDTYSYSSARQGLLVGMVNTGTTVGCLLSSPLGDRFGKRKCIMGWTLVYITGVIVQLTTIPSWVQMMVAKIWTGLGIGALSVIAPGYQSESSPPHIRGAIVTTYQLFITLGIFIAACINMGTHKYTTHPEAQWRVPIGINLLWGILMFFGMLFLPESPRYLAVKGRNEECMKILTRNAGLPADHPIMQKEYNAIQADVEAELAGGPCSWPQIFSNEIRYRTLLGMGVMAFQQLTGNNYFFYYGTQVFRGTGLNSPFLAALILDAVNFGCTFGAIFVLEYFGRRGPLIVGGVWQSICFFIYASVGDRALTRPNGTSNHRAGAVMIVFSCLFIFSFAQTWAPAAYVIVGESYPIRYRSKCAAVATASNWFWNFMISFFTPFISNSIGFKYGYVFAACNLCAAIIIFLFAKETKGLTLEEINQLYLSNIKPWNTGAYQRDREDIKQSDSEKERGPTSKLHEYVEHAPNSYASTHSTESENYPQQVTNPVGL

SEQ ID NO: 239 - DNA, 1641 bp, Schizosaccharomyces pombe
  CDS (1)..(1641)
atgggaaaaaatttgaccattgtcatgttggtcttcgtgtccatggccggatggatgtttggcgccgataccggttccattggtggtatcaccaacatgagagatttccaatctcgtttcgcagatcggtataatccggtaacagattcgtattcgtattcttcggcgcggcaaggtctaattactggtatggttaacgttggttctttctttggttgtttcctttcttcccctcttatggatcgcattggtaagcgtacctctattatgttttggactattgtttatttgattggtattattcttcaagttaccgctgtcccatcttgggtccaaatcatggttgctaagatttggactggtctttccattggcgccttgtctgtgcttgcccccggtttccaatctgaggttgctcccgccgatcttcgtggtaccattgtcaccacctatcaattggctgtcactggtggtattttcattgccgcttgtatcaacatgggtactcacaagttgcacaagactgctcaatggcgtgtatccatgggtattaacttgctttggggtatcatcaccttcatcggtatttctttccttcctgaatcccctcgttatttgatctctgttggtagagatgaagaggctcttcaaattatggccaagaacaacgatcttcctatcgaacacgaagttatccaaacggaataccatgttattaagtctgattgtgaagctgaattggctggtggtcccgctacttggcccgaaatttttggtcccgacattcgttatcgtaccttccttggtcttggtgtcatgtctcttcaacaacttaccggtgataactactacttctactatggtttcgaggtgtttgagggtactggtatgaactctccttatctttctgctttgattcttgatgccgttaactttggatgtacgtttggtggtcttttcgtcctagagttctttggtcgtcgtatgccattgattattggtgctctttggcaatccattactttcttcatttacgcagctgttggtaatcgtgctcttactcgtaagaatggtacctcaaaccatcgtgccggtgccgttatgattgtgttctcatgtcttttcattttcagttttgctcaaacttggggtcctgccgcatacgttatcgttggtgaatcgtatcccattcgttatcgttccaagtgtgctgccgtcgctaccactggtaactggttgtggggtttccttatttcctttttcactcccttcattaccaactccattggattcaagtatggttacattttcgctgcttgtaacttgtgtgctgcttgtattattttcttgtttgctcatgaaaccaaaggtcttaccttggaagagattaacgaactatatatctctggtgctaagccctggatgcctagacctaagaaccttggtaacttcaccaagcaacaagaagaggttcgtgaaaaatcccgtggtgttcaaggcgaaagtgccgctcatcttgaaaacgttgacggtgaggaaggtattgaggactctagcaatgacattagttccacaacatcttcggatggccgtgccaagcccgaatctagctaccacgatcaggaagaacaattcgcatag

SEQ ID NO: 240 - protein, 546 aa, Schizosaccharomyces pombe
MGKNLTIVMLVFVSMAGWMFGADTGSIGGITNMRDFQSRFADRYNPVTDSYSYSSARQGLITGMVNVGSFFGCFLSSPLMDRIGKRTSIMFWTIVYLIGIILQVTAVPSWVQIMVAKIWTGLSIGALSVLAPGFQSEVAPADLRGTIVTTYQLAVTGGIFIAACINMGTHKLHKTAQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDAVNFGCTFGGLFVLEFFGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFAHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 241 - DNA, 1913 bp, Schizosaccharomyces pombe
  CDS (240)..(1913)
actttacacattttttggccctcctttcatttgtcaagtcgtgtttgcaatcacgaattcttttaaaatctttttgtttcttgtactaagcataccttatttttcaggcaagttttccttcttataaatctgcgtttccttgccaaacatttgtatcttaatttgctcctttttttgtcgatacacccttaaaaatttatatcatctgcaaaatttgttaattatttttctattctattatgggaagaacacttacatctgtcctcgtggtcttcatttctatggccggatggctaggaggtgctgataccggttccattagtggtatcttgggaatgcgtgattttcaatctcgttttgctgaccggtataatcctatcacgaactcttatagttactcagcctggcgacaagcactgttgacaggaaccgttaacgctggttgcttatttggtgctatgctttcctctccatttactgaagccattggcaaaaaatactccattgccttctttagcggttgttacattattggtcaaattcttttggtaactgctgttccttcttgggttcagattatggttggtaagttatttacaggtttaactattggtgctttgtcggtgttgagtcctggataccaatctgaagttgctcctccgcaaattcgtggtgcagttgtttcgacctatcaactatttcaaacttgcggtactttaatcgctgcttgtatcaatatgggaactcataaacttcgtaaaacagcgtcctggagaacttcctttggcattaacatactttggggtatctttttgatggtgggtgtactgtttttacctgaatcaccgcgttacctcatctataagggaagagatgaagaggctcttcgaatcatgtgtcaaactgctgaactagatcctgagagtgaaatcattcaaaccaattttaataccattaagagtgatattgaaatggaaatggctggaggtaaggcaagatggcctgaggtttttggaaaagaagttcgctatcgtactgtcttgggattccttactatgttactgagagaattgattggtaataactattacttttattatgctacacaagttttcaagggaactggtatgacggatatattcttaccagccgttattttaggtgctattaattttggtacaacgtttggtgctttatacacaattgataacttaggacgtcgtaacccactaatttttggagctgctttccaatcgatatgcttctttatatatgccgctgtaggcgatcgaaagctcatatataagaatggtactagtgatcacagagcaggagctgtaatgattgtgttttcttgtttgtttcttttctcttactgctgttcttggggcccaatgggctgggttattgtcggcgaaacctttccaatacggtatcgtagcaaatgtgctgctgtagccacatcgggtaattggctgggcaactttatggtttcattcttcactcctttcatctcaaattctattgggttcaaacttggatatatttatgcttgtatcaatatgacttctgcgtttcaaatatttttgatggccaaagaaactaaaggccttaccttggaagaagttaatgaattatacgagtctgacattaagccatgggattcctataagtacgtgagacaaattgaatctcgtcgtatacacttcagtaaagaagaagaaaagcgagaaagagagaagtcaaaaggataccgcggtcaagaagaacgttttatcgaaaatgcagatggtgcggataatgacgatagcagcgcttcttcagaatcctttgcatctgctggcgcacactccagatcggtttttcctaggaggtcaaacgtgtcagaagaatcacacccgacttgggtataa

SEQ ID NO: 242 - protein, 557 aa, Schizosaccharomyces pombe
MGRTLTSVLVVFISMAGWLGGADTGSISGILGMRDFQSRFADRYNPITNSYSYSAWRQALLTGTVNAGCLFGAMLSSPFTEAIGKKYSIAFFSGCYIIGQILLVTAVPSWVQIMVGKLFTGLTIGALSVLSPGYQSEVAPPQIRGAVVSTYQLFQTCGTLIAACINMGTHKLRKTASWRTSFGINILWGIFLMVGVLFLPESPRYLIYKGRDEEALRIMCQTAELDPESEIIQTNFNTIKSDIEMEMAGGKARWPEVFGKEVRYRTVLGFLTMLLRELIGNNYYFYYATQVFKGTGMTDIFLPAVILGAINFGTTFGALYTIDNLGRRNPLIFGAAFQSICFFIYAAVGDRKLIYKNGTSDHRAGAVMIVFSCLFLFSYCCSWGPMGWVIVGETFPIRYRSKCAAVATSGNWLGNFMVSFFTPFISNSIGFKLGYIYACINMTSAFQIFLMAKETKGLTLEEVNELYESDIKPWDSYKYVRQIESRRIHFSKEEEKREREKSKGYRGQEERFIENADGADNDDSSASSESFASAGAHSRSVFPRRSNVSEESHPTWV

SEQ ID NO: 243 - DNA, 1767 bp, Neurospora crassa
  CDS (1)..(1767)
atgatctcggcatacccttccacatatgcttccgatcgctctgttgtgttcttacatacctctcgaaataaaacaagctttacaacgagcagtgtcgccatgaagccatttctggggctcagaggtcagcccctcaacctggccgtgggcgcagttgccggatgtgattttcttcttttcggatacgatcagggtgttatgggcggaattctgactctccccgagttcctcggttactttgaacaaatcaatccagacgcaccgggcctcacaccacacgaatcttctatgcgatctacttaccaaggcatctccgtcgcttcctacaacctgggatgttttatcggcgccatcatcactatcttcattggcaatccctggggccgtaagaaaataatattgctcgggacttctatcatgattgtcggtgccattcttcaggccagcgctactactctaggccatttcatcattgggcgtatcattaccggcattggaaacggaggaaacacatctacttcgcaggtccctacttggcaatccgagacttcgaaagcacacaagcgaggcaagatggtcatgatcgaaggatctctcgtcaccgccggcatcatgttgagttactggattgacctcgggttaagttttgcccctggctcagttgcttggcgcttccctcttgccttccagatcatcttctgcatcctcatcctcatctttattcccttcctgcccgaatcacctcgttggttggttttcaaaggccgcgacgcggaagccaaggaaatcctggccgccctcaacgacgtggaacttgacgatcccattgtcgacaccgagttccatttcatccacgatacggttgtcgagatgtccaaaggcagcttcaaggacctcttcaccatggacaaggaccgcaacttccaccgcactctgctggcatacctcaaccaggttttccagcagatctctggtataaacctcatcacctactatgccgccgtcatctacagcggacttggcatgtccgacttcctggcccgtctcctcgccgccctcaacggcaccgagtacttcattgcctcgtggccagccgtcttccttgtcgagcgcgtcggccgccgcaagctcatgttgtttggtgccatcggccaagcggccaccatggccatcctggcaggcgtcaactcccggccagacgacaagccataccaaattgcgggaatcgtctttctgttcgtcttcaacacggttttcgcggtcggctggctcggcatgtcctggctctacccagccgagatcgtgccgctccgcatccgcgccccggctaacgcgctatccacgtcggcgaactggatcttcaactttatggttgtcatgatcactccggttgcgttcaacaaaatcaagtatcagacgtacatcatcttcgccgtcatcaacgcctttattgttccagtcgtctatttcttctatccggaaacggcgtgccggtcactagaggaaatggatatgatcttccacaaggttgatgggtggaaggggtacttcacggtagtgcaccaggccaaggttgagcctaaatggtacgacaaggatggccagcgcattggcggggctgactttgagaagactgctgggtaccagagccactcgattccggagtcgtctggatttgaaaagccgacgaaggcgcatgttgagtcgcctagggcggatgacgggatcacttcgtcgagtagtgatggaggtaatcgggagtcgtag

SEQ ID NO: 244 - protein, 588 aa, Neurospora crassa
MISAYPSTYASDRSVVFLHTSRNKTSFTTSSVAMKPFLGLRGQPLNLAVGAVAGCDFLLFGYDQGVMGGILTLPEFLGYFEQINPDAPGLTPHESSMRSTYQGISVASYNLGCFIGAIITIFIGNPWGRKKIILLGTSIMIVGAILQASATTLGHFIIGRIITGIGNGGNTSTSQVPTWQSETSKAHKRGKMVMIEGSLVTAGIMLSYWIDLGLSFAPGSVAWRFPLAFQIIFCILILIFIPFLPESPRWLVFKGRDAEAKEILAALNDVELDDPIVDTEFHFIHDTVVEMSKGSFKDLFTMDKDRNFHRTLLAYLNQVFQQISGINLITYYAAVIYSGLGMSDFLARLLAALNGTEYFIASWPAVFLVERVGRRKLMLFGAIGQAATMAILAGVNSRPDDKPYQIAGIVFLFVFNTVFAVGWLGMSWLYPAEIVPLRIRAPANALSTSANWIFNFMVVMITPVAFNKIKYQTYIIFAVINAFIVPVVYFFYPETACRSLEEMDMIFHKVDGWKGYFTVVHQAKVEPKWYDKDGQRIGGADFEKTAGYQSHSIPESSGFEKPTKAHVESPRADDGITSSSSDGGNRES

SEQ ID NO: 245 - DNA, 1596 bp, Aspergillus parasiticus
  CDS (1)..(1596)
atggcggtccttcattctggggttgtgtgtctcgatgggtggttttatcttcggttactccaccggtatgtcaacttccctgtggggtacctaccatgcttcgtgctgactttcacctcaggtcaaattgctggctttacgactatgaatgatttcaagatgcgctttgcggaacaacatgcggatggaacatacgctttcagcaacgtgcgcaatggtttgattgtcggtctgttgtccattggtactatgattggcgccctcgtcgccgctcctatcgccgatcgcattggtcgcaaatactctatctccttctggtctgtgattcacatggttggtatcatcattcagatcgccaccgacgacaactgggtccaagttgctatgggtcgttgggtggccggtctggttgtcggcgctctgtccagcatcgtccctatgtaccagagtgaatctgctcctcgtcaggtccgtggtgccatggtcagcgccttccagctgttcgttgcttcggtattttcatctcttatctcgtcaacttcggtaccgaatccatcaacggtaccgcttcctggcgtatcactatgggacatgtgtgcctggcccttgatcttgggtgttggcactctgttccttcccgagtctccccgttatgcctaccgtaacggtcgtgtcgaagaagcccgtgaggttatgtgcaagctttacggcgttggccccaaccaccggtgcatcgcccaggagatgaaggacatgaaggacaagctcgatgaggagaaagctgccggacaggcttggcatttcgaagtcttcactggtcctcgtatgttctaccgtgtagctggaattgctttacagtcactgcagcagctcactggcgccaacttcctcttctactatggtaacaccatcttcacttctaccggtctgaacaacagctacgtcacccagattattctgggtgccgttaacttcggcatgacccttcctggtctctatgttgttgagcacttcggtcgtcgtaatagtctgatggtcggtgcctcctggatgtttatctgcttcatgatctgggcctccatcggtcacttcgccttggacttggagaaccctcccaacacccctcaggcgggtactgccatgattgtcttcacttgcttcttcatcggtggcttcgccaccacctggggacctattgtgtgggctatctgtggtgagatgtaccctgctcgctaccgtgctgtctgcattggtcttgccactgccgccaactggagcctgaacttcctgatctctttcttcaaccccattcatctccagcgctatcgactttgctacggttacgtctttgcaggctgctgcttcgccgccgtgcttgtggtcttcttcttcgtcaacgagacccagggtcgcacccttgaggaagtcgacaccatgtacgtcctccacgtcaagccctggaagagtgccagctggacgccccggagggtatcgtccgtgatctccacggaccccccgcttcccccaagcaggagggtcgggctgagcacagcgagcccgccaccgagatccgcgagtaaatggtatcatgtctga

SEQ ID NO: 246 - protein, 531 aa, Aspergillus parasiticus
MAVLHSGVVCLDGWFYLRLLHRYVNFPVGYLPCFVLTFTSGQIAGFTTMNDFKMRFAEQHADGTYAFSNVRNGLIVGLLSIGTMIGALVAAPIADRIGRKYSISFWSVIHMVGIIIQIATDDNWVQVAMGRWVAGLVVGALSSIVPMYQSESAPRQVRGAMVSAFQLFVASVFSSLISSTSVPNPSTVPLPGVSLWDMCAWPLILGVGTLFLPESPRYAYRNGRVEEAREVMCKLYGVGPNHRCIAQEMKDMKDKLDEEKAAGQAWHFEVFTGPRMFYRVAGIALQSLQQLTGANFLFYYGNTIFTSTGLNNSYVTQIILGAVNFGMTLPGLYVVEHFGRRNSLMVGASWMFICFMIWASIGHFALDLENPPNTPQAGTAMIVFTCFFIGGFATTWGPIVWAICGEMYPARYRAVCIGLATAANWSLNFLISFFNPIHLQRYRLCYGYVFAGCCFAAVLVVFFFVNETQGRTLEEVDTMYVLHVKPWKSASWTPRRVSSVISTDPPLPPSRRVGLSTASPPPRSASKWYHV

SEQ ID NO: 247 - DNA, 1711 bp, Amanita muscaria
  CDS (38)..(1600)
ataacctgccccccccaaattttctggcccttgaaccatgcctccagctgctacggggaatggcggcatagatcccaaaaacaaatttactggcatagccatgacagcattcagtgcttttggtggtatcctctacggttacgacactggcattatcagcggtatccttgcgatggacgatttcaagcgtacctttggtcaacaggcttctgatggcacatgttcccttccgctctcaagccaatccctgtttgtctctattctctcagctggaaccttcgtcggagctctctttggtgctcccatgggtgacattatcggcagaaaatggggtatcgtcatagctgctgcgatattctcgatcggtattgccttgcaaacagcctcagtaacggcagctcccttcgtcgttggtcgtgtcttcgccggtcttggtgtcggtctggtttcttgcctggttcctatgtatcagtccgaatgctcaccaaaatggatccgcggtgccgtagtatcattgtaccaatgggccattacgattggaatcttgcttgctgccgtcatcaacaacgccacccaaggccgtagcaaccactctgcctatcaaatccccatttctattcagtttgtctgggcatttatccttgggtttggcatgatgcttttgccggaatccccccgttttctcgttaggcaaggtcgcgacgaagatgctgccctgtccttgtcccgtcttacgaggctctcgcctgatgaccccgttgtcagaaatgaattggccgagattcgcaccaattttgaggctgaactggccctcggtgaaagctcgtacttggattgcttcagaccctcgcacaacaaaattttgttgcgtaccctgactggtattttcattcaagcttggcaacaacttacgggcatcaactttattttctactatggtacacaatacttccagaacgctggcatcaatcaagcattcctcattaccattgccaccggtatcgtcaacgtattcatgacattaccgggcttgtatggtgtcgaacgctatggtcgccgttccctcctccttattggtgcactaggcatgacgatttgcgagtttattgttgctatcgttggtgtcacgatccccgcctcgaatctagcaggtcagagagtgctaattgcattcgtttgcatttacatcgctttcttcgcatctacctggggtcctatgctttgggttatcgttggtgaaatctttcctctacaagtccgtgccaagggcatttcgctttctgttgccagcaactggttgtggaacttcggtattgcctttgctacaccttaccttgtaaatacccaagcgggatcagccggtctcgggtcaaaagtgttcttcatctggggcacaacatgtgcttgctgtcttgtctttacgtacttctgcgtgcccgagaccaagggcttgtctctcgaacagattgacgagatgtatcaggaagtaatgccattaaaatcctaccaataccgccgacgcctcgcgatagaaggcggatttaggacagaaaaggctgatatcatacacgaggaaacggcagaaaaggaaagcgggtaacagtttctacccttgtatcatgtttttctccacgtaattagttcttcagacttgtgatacaaaatgtcatcgtaagttacttgaagccgcccaaaaaaaaaaaaaaaaaaa

SEQ ID NO: 248 - protein, 520 aa, Amanita muscaria
MPPAATGNGGIDPKNKFTGIAMTAFSAFGGILYGYDTGIISGILAMDDFKRTFGQQASDGTCSLPLSSQSLFVSILSAGTFVGALFGAPMGDIIGRKWGIVIAAAIFSIGIALQTASVTAAPFVVGRVFAGLGVGLVSCLVPMYQSECSPKWIRGAVVSLYQWAITIGILLAAVINNATQGRSNHSAYQIPISIQFVWAFILGFGMMLLPESPRFLVRQGRDEDAALSLSRLTRLSPDDPVVRNELAEIRTNFEAELALGESSYLDCFRPSHNKILLRTLTGIFIQAWQQLTGINFIFYYGTQYFQNAGINQAFLITIATGIVNVFMTLPGLYGVERYGRRSLLLIGALGMTICEFIVAIVGVTIPASNLAGQRVLIAFVCIYIAFFASTWGPMLWVIVGEIFPLQVRAKGISLSVASNWLWNFGIAFATPYLVNTQAGSAGLGSKVFFIWGTTCACCLVFTYFCVPETKGLSLEQIDEMYQEVMPLKSYQYRRRLAIEGGFRTEKADIIHEETAEKESG

SEQ ID NO: 249 - DNA, 1425 bp, Tetragenococcus halophilus
  CDS (1)..(1425)
atgaagtcacacccgcttacgcttactcaaaatattatgaataataaaggattaaatcgctatgttattacaattaccttaattgcaactttgggaggtctattattcggttatgatactgctgttatatctggtgctgaacaatctatccagaataatctagttaatggagtaggtttaggttcctttgctcacgggttaacagtttctagcgcacttattggttgtgtttttggaggtctattatctggaatattttcaaataatttggggagaagaaactctttaaaattagcaggtagcctctttttaatttccgcattggggtctgcgtacccagaatttttgttctttcaagccggtgatgcatcagttggtcttctaattgtatttaatttataccgcgttcttggtggtatcggtgttggaatggcttccggtatatctcccacatatattggtgaaattgctcctggaaaagttcgtggcagcctagtttcgtggtatcagtttgctattatttttggacaattagttgtatatttcgtaaattggggaattgccaccggacaatcaccagaatgggtgaatgatattggatggagatttatgtttgcttcagaagcaataccggctattttattttttgctttgttgttttatgtacctgaaacacctagatacttagtgttaaaaaataacgaagaaaaagcttttgacgttttatctaaaattaacaactctaaagaagaggcaaaagatatattaactgatattaaaggctctctaaatacaacagaaacgagtggtaagttattttcttatggtaaaactgtagtcattgtaggtgttttactctcaatatttcagcaattcataggtattaacgttgctttatattatgcaccaagaatatttgaaagtatgggcgccggccaaaatgcctcgatggtacagacaatcattatgggaattgttaacgtgacatttacctatgttgcgataagaactgtagataaatgggggagaagaccgttgttgttagttggatcaatagggatggctattggtatgttcgctgttgcgttgcttgcgaaaaatggtgtgttgggtatttggacgttagtctttatcatagtttatacggcctcctatatgatgtcgtggggaccgattgtttgggtgttactttctgaaatattccctaacaaaatcagaggacaagcaatggcatttgcagttgctgctcaatggctatcaaacttctttatttcatcaacctatcctgcaatgatagactttagtggaccgctaacttatggattttatggtttgatgtgtgttatttccgcaatttttgtatggaagatggtcccagaaacaaaaggaaagacgcttgaacaattagaaaatacttggttataa

SEQ ID NO: 250 - protein, 474 aa, Tetragenococcus halophilus
MKSHPLTLTQNIMNNKGLNRYVITITLIATLGGLLFGYDTAVISGAEQSIQNNLVNGVGLGSFAHGLTVSSALIGCVFGGLLSGIFSNNLGRRNSLKLAGSLFLISALGSAYPEFLFFQAGDASVGLLIVFNLYRVLGGIGVGMASGISPTYIGEIAPGKVRGSLVSWYQFAIIFGQLVVYFVNWGIATGQSPEWVNDIGWRFMFASEAIPAILFFALLFYVPETPRYLVLKNNEEKAFDVLSKINNSKEEAKDILTDIKGSLNTTETSGKLFSYGKTVVIVGVLLSIFQQFIGINVALYYAPRIFESMGAGQNASMVQTIIMGIVNVTFTYVAIRTVDKWGRRPLLLVGSIGMAIGMFAVALLAKNGVLGIWTLVFIIVYTASYMMSWGPIVWVLLSEIFPNKIRGQAMAFAVAAQWLSNFFISSTYPAMIDFSGPLTYGFYGLMCVISAIFVWKMVPETKGKTLEQLENTWL

SEQ ID NO: 251 - DNA, 2846 bp, Pichia stipitis
  CDS (175)..(1836)
gcatgcatcaccagacagcataaaaaaataaaaagtttttccgaaatgcaatgaggcagttttagcagcttatttttgttaggctcaaattataacttctataaatacaacagcatttctccccaagaaagattttttgaatacttgtctacataagttaaataactaattaaaatgtcttctcaagatattccttcaggtgttcaaacaccttcaaatgcttcctttttagaaaaggatgaagataagattgaagaagtaccccaaaaccatgatgcaaccttggtagccttggagtccaagggtatttctgaatatcttttgatttgtttcttctgtttgttagttgcttttggtggttttgtctttggtttcgacactggtaccatttctggatttgttaacatgtctgacttcttggaaaggtttggtcaaaccagagctgacggcactcactacttgtccaatgtcagagttggtttgcttgtgtctatcttcaatattggctgtgctattggtggtattttcttgtccaagattggtgacgtctacggtagaagagtcggtattatggcttccatggttatctacgtcgttggtatcatcgtccaaattgcttctcaacacgcttggtaccaagttatgattggtcgtgccattactggtttggctgttggtaccgtttctgtattgtctccattgttcattggtgaaagttctccaaagcacttaagaggtaccttggtttactgtttccaattgtgcattactttgggtatcttcattggttactgtgtcacctacggtactaaaagattatccgactctagacagtggagagtgccattaggcttgtgcttcctctgggctattttcttggttgttggtatgttggccatgccagaatctccaagatacttggttgaaaagaagagaatcgaagatgccaagaagtctgtcgctagatccaacaaattatccccagaagacccaagtgtctacactgaaatccaattgattcaagctggtattgacagagaggctattgctggatccgcttcctggactgaattgattaccggtaagcctgccattttcagaagagttgttatgggtatcatcatgcaatccttacaacaattgactggtgtcaactactttttctactacggaactaccattttccaagctgtcggattgaaggactctttccaaacctctattatcttgggtgttgtcaactttgctgctaccttcattggtatctgggccattgaaagatttggtagaagatcttgtttgttagttggttctgctggtatgtttgtttgtttcatcatttactctaccattggaagtttccacttgtacaaggatggtgaatacaacaacgacaacacctataaaccatccggtaacgctttgatcttcattacctgtttgttcattgttttctttgcctccacttgggccggtggtgtctacaccatcatctctgaaagttacccattgagaatcagatccaaggctatggccattgccactgctgctaactgggttttcggtttcttgatctcatttttcactccattcattgttagtgccattcatttcaagttcggttacgttttcagtggatgtttattattctccttcttctacgtctacttcttcgttgttgaaaccaagggtttgtccttggaagacgtagacgaattgtacgcttccaacgtggttccatggaaatccagcaagtgggttccaccatcgactgctgccatggctaccgaagctggttacgctgctgatgaaaagcctgttgacgaacatgtttaaatccctaatgtcttatgcatagcattctcacgataaaaaagttatagatagtttcccttaatgtttcatagacctaatgttataaaagattgaaatcgtacgtagttcttctatgctgactctattttgcttctagcgtaatgcaaaaattatttctcttggaacccagatatgcctctttctttgtaaatacctgaagtttctggtgccttttcccctgccagtcaaatagccaataggctaccttttttgcctcgtagtaaaacacttgcttgaatccaagacttgccattatcttttggaggatctcgttgtcaaagtaccgagagttggatatacatggcaatggtagaacaagaaacaaagaacttaaggtgtcctttgtaggctctctgaggaacttggttattcgaagaagcatgtctcctctttctttaggagatggcacaaaatttatcaccaacgaacacgatataagattgaatttttcagagttgtttctgggcaatggtctttccatgaagttctgttctagtataagaggactctgggagtttaaatctattctaacaatgctatcaaatatcccacatgtcgatatgagattgttgggacttaagcatccaatctctaaagcactattttggttcaatctagatttgtactcctctgtcttaagccattccaccaaccgtttagaagaatctcctcctctttttgcagtctggccctgagtcgaagcactctggtaggcttcgattccaccacgggcttcaatttcactatctatttctgccaaaagttgaaccaattgcgttgtggagagtgagtcgtctactttgacaaaggtggaattgttcttgactgacgaaagatcaaatttgtcaaaactttcttggaaaaccttctccaagttctttacatctttgattattgccttgtaattttcgatattaacttcagacaataccctactctttgtcgcctggagttttcgtattatagcatgc

SEQ ID NO: 252 - protein, 553 aa, Pichia stipitis
MSSQDIPSGVQTPSNASFLEKDEDKIEEVPQNHDATLVALESKGISEYLLICFFCLLVAFGGFVFGFDTGTISGFVNMSDFLERFGQTRADGTHYLSNVRVGLLVSIFNIGCAIGGIFLSKIGDVYGRRVGIMASMVIYVVGIIVQIASQHAWYQVMIGRAITGLAVGTVSVLSPLFIGESSPKHLRGTLVYCFQLCITLGIFIGYCVTYGTKRLSDSRQWRVPLGLCFLWAIFLVVGMLAMPESPRYLVEKKRIEDAKKSVARSNKLSPEDPSVYTEIQLIQAGIDREAIAGSASWTELITGKPAIFRRVVMGIIMQSLQQLTGVNYFFYYGTTIFQAVGLKDSFQTSIILGVVNFAATFIGIWAIERFGRRSCLLVGSAGMFVCFIIYSTIGSFHLYKDGEYNNDNTYKPSGNALIFITCLFIVFFASTWAGGVYTIISESYPLRIRSKAMAIATAANWVFGFLISFFTPFIVSAIHFKFGYVFSGCLLFSFFYVYFFVVETKGLSLEDVDELYASNVVPWKSSKWVPPSTAAMATEAGYAADEKPVDEHV

SEQ ID NO: 253 - DNA, 2054 bp, Beta vulgaris subsp
  CDS (94)..(1731)
atcaatccaaaaaaatcaaaaggaaacaaattcccatctttccttactttctctctctttttctctctcttattggtgagaaataagtgagccatgagtgaaggaactaataaagccatgtcagacccaccaccaacaactgcaagcaaagtaatagcagattttgatcctttaaagaagcctcctaagagaaacaagtttgcttttgcttgtgctactttggcttctatgacttctgttttacttggttatgacattggagtaatgagtggtgcaataatctacctcaaagaagactggcacattagtgacacacaaataggagttctagtcggaatcttaaacatctactgcctcttcggctctttcgcagctggtcgaacttccgattggatcggacgacgttacaccatcgtattagctggtgcaatcttcttcgttggcgcactactcatgggtttcgccacaaactacgcatttctcatggtaggccgttttgtaacaggaataggtgttggttatgcacttatgatcgcacctgtttacactgcagaggtttctcctgcttcttcaagaggatttcttacctcttttcctgaggttttcatcaatgcaggaattttgcttggatatatatctaaccttgcattttcaagcctcccaactcatttgagctggaggtttatgctcggaatcggggcgattccgagcatatttttggctattggagtgcttgctatgcctgagtcaccgcggtggcttgttatgcagggaaggcttggagatgctaagaaggtgcttaatcgcatatctgactcgcctgaggaggctcaacttaggctcagtgagattaagcagacagcaggaatcccagctgagtgtgatgaagacatctataaggttgaaaaaacaaagataaaatcagggaatgcagtttggaaagagctcttcttcaaccctactcccgcagtgaggcgtgcagtgattgcaggtatcggaattcactttttccagcaagcttccggcatcgacgccgtggttttatacagtccaaggatctttcagagtgctggaatcacaaatgcacgtaaacagttacttgcaacagtagctgtaggagttgttaagacacttttcatattagttgctacatttcaattagacaagtatggtagaaggcctttactattaacaagtgttggtggtatgatcatagccatcttaaccttagccatgtctttaactgttattgatcactctcatcacaagattacatgggctatagccttgtgtataaccatggtttgtgctgtcgttgcgtcgttttcgattggtttaggaccaattacatgggtatatagttcagaggttttccccttaaggttaagggctcaaggtactagcatgggtgtggctgttaatagagttgtaagtggtgttatttcaatatttttcttgcctttgtcacataagattacaacaggtggtgccttctttttgttcggagggattgctattattgcttggttcttcttcttgacgtttcttcctgagactagagggcgtacacttgagaatatgcatgagttgtttgaagattttagatggagggagtcatttccaggcaacaagtcaaataatgatgagaatagcacaagaaaacaaagtaatggtaatgacaagagtcaagtacaattgggagaaactactactagtagtgtacaagtatagttatgtacggatgttatgtcatgtatagctgttcgacttttaatgacgataattaatctcaaatcgaacaagtttctaagatgtgtgtgtataagatgtgcgtgatgtacgtacttgttatacacatgttgttcttagaatgtgatcctctttattttcgcaaatacattgtagcaaattaaagtaatctaattataggataccaaatggttcaaaaaacaatgtcttttgtgtgattttgtatgatgcttcatcatttgtcagtttaccctttttttggtaatgaagacaaaataaattcatgagtttagctttaaaaaaaa

SEQ ID NO: 254 - protein, 545 aa, Beta vulgaris subsp
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSSVQV

SEQ ID NO: 255 - DNA, 1758 bp, Debaryomyces hansenii
  CDS (1)..(1758)
atgtctataaaatcgagctcttggaacccccatttctcagattcctgctacagaaagcaagagaattctatatggaatatgagcgaagtgaaaccagagacggagcacgtagaacataggaaggatgaaaaaaatgtccatgttggcatccagtcgattccttcattagatgctgatgggaagcctatagaggtttcagaagtagagcgacctaagttgctcagtaagcatttgataccactttattgttgttgccttattgtgtacttttgttctactatgaatggattcgatggtagtttaatgggtagtatttatactttaccagactaccttgagtattatgacttagatatgagttctactggaactggactcattgtctctatatattatgttggacaaatagttggcgcattcttttgctctttgatggattggaagggaagaaaagtagctattcttacgggttgttttggtgcttgtattggtgcggtgattactgcagttgcaaaagacactaaaacgttaattggcggtagattctttctttctttctgtactacgattgctgttgctgctgctccagcatactgtgttgaaatttccccatcccatcttagaggtactgttgccggtctttataatactctctggtatgtgggctctcttgttgctgcattcacggcttatggtgcagatttgaattatcgtgggtccaccaaatcgtttaagcttcctctttggttgcaaataatttttcctgctatagtagtattatttgggtggcttatacctgagtctccaagatggttggttggggttaaaagaattgatgaggctagaaaaattattgccaaataccattgtaacggtgacgaaaatcatccattagtagatcttgaaatagcagaaatgattgactccttcaacgatgtaaaactttctgatcctattaaggtgcttgacatgaggccattagtcacaaaacgttctgatagatacaggctcggtttagtgattgcaatgtcttggtttggacagttctcaggaaacaatgttgcttcttactatcttccaacaatgctcaataaagtcggtatgacttcagcttcaactaatgtactcatgaatggtatatattctctcgtttgttggtttgcctcaatattggggtctttttcacatgataaggtcggtagaagaaagatgttcatgttttctactataggtgcatccttaatgttatcggggcttgctatatgtacagccagatataacatcacaccaacgcaagctgcttcaactggtacacttgttttcatatatctctttggtgtgatcttctcatttgcattcacaccaatgcaaccaatttacccatccgaagtttcatctaatatcttgagatctcgtagtatgatcgtcctctatgttacatcaggtatcgcatcgttcgttaaccaattttcagcaccgaaggcgatggaaaatataggatattggtattatgtttttttcgtcttctgggatatttttgaatttgttattatctatttcttttttgttgaaactaggcataaatctcttgaagagttagaaaaaatattcgaagcaaaaaatccaaggaaggtttctgttggaaattacagcgatgaagacgagaaaattgaagaggtagaggttgcaaggcaaaagcatgttatagccctcacgaatcaattcgttaacgaaagattggctaaccaagatgtataa

SEQ ID NO: 256 - protein, 585 aa, Debaryomyces hansenii
MSIKSSSWNPHFSDSCYRKQENSIWNMSEVKPETEHVEHRKDEKNVHVGIQSIPSLDADGKPIEVSEVERPKLLSKHLIPLYCCCLIVYFCSTMNGFDGSLMGSIYTLPDYLEYYDLDMSSTGTGLIVSIYYVGQIVGAFFCSLMDWKGRKVAILTGCFGACIGAVITAVAKDTKTLIGGRFFLSFCTTIAVAAAPAYCVEISPSHLRGTVAGLYNTLWYVGSLVAAFTAYGADLNYRGSTKSFKLPLWLQIIFPAIVVLFGWLIPESPRWLVGVKRIDEARKIIAKYHCNGDENHPLVDLEIAEMIDSFNDVKLSDPIKVLDMRPLVTKRSDRYRLGLVIAMSWFGQFSGNNVASYYLPTMLNKVGMTSASTNVLMNGIYSLVCWFASILGSFSHDKVGRRKMFMFSTIGASLMLSGLAICTARYNITPTQAASTGTLVFIYLFGVIFSFAFTPMQPIYPSEVSSNILRSRSMIVLYVTSGIASFVNQFSAPKAMENIGYWYYVFFVFWDIFEFVIIYFFFVETRHKSLEELEKIFEAKNPRKVSVGNYSDEDEKIEEVEVARQKHVIALTNQFVNERLANQDV

SEQ ID NO: 257 - DNA, 1608 bp, Debaryomyces hansenii
  CDS (1)..(1608)
atgccagttagcattgaaaaacctgaaaatttagaaaaccccacgttaaactcgagtagcttagaaagcttaaaccagtcacgaaagacattcgttggtttacgtggggaggcattatataaaatggtggcattcgttgcgagtattgcatttatgctattcggatatgatcaaggtgttatgagctcgttactaacgctaccatcgtttttggaaacgtttcccgaaatcaatgttttcgaaaataagtcgaactccacattacaagggttggtggtggctatatatgaaataggctgtatgtgtggtgcactttttgcgatggtttatggagacaattttggtagaagaaagatgatttggatcggtgctgcaacaatgacagtcggagcagtgttgcaatgctcggcatttggactacctcatttaatcgttggaagaattgtaacaggtatcgggaatggtttcctgactgcaacaattccaatgtggttgtctgaatgtgcaaaaccagagagacgtggtgctcttaacatgattagcgcagctctaaatatatttggtgttgcattatcttactgggtcgatttcggcttctattttgttaagggcagtgccagttggagatttccaattgccttccaaattgtatttgctttgttcatgatgtccgtcatcttcttaatgccagaatccccccgttggttagtcaaaaagaatagaattgaggaagcaaaggaagtatttgcggtgtttgctgaagttgaaaccaatcacacttttgtgttagcaaaaattaaagaaatcaaagatctttctatgaaagaagatgcagaattcagtttgaaacgcctaatttcatttggaccaaacaaacattttcacagaacaatgttggctgcattttgccaaattatgcaacaaatttgcggaataaatctaattacctattatgcaggtactatttatgaagactatttaaatatggatcctattcctgcaagaattttagctgcttgtaacggtacggaatatttccttgctgcttgtctttcatactttcttattgaaagagtagggagaagaaatttgatgttaatttgtgctgcaggacaaagtgctactatggctattttgtgtgggtcaggatgggcagctgataacggggatacaaaggctgcaatatcagctgcagtattcctcttcgtgtttaatagtttttttgcagttggatggttgggtgttctgtggctttaccctgctgaaattgctccattggaaataagagcagcagtgaatgggttatcgacagcttgcaactgggcgtttacgttcttaatcgttatgattacacctatatgcttcgcacatatcggtgcatatacttatgctatattcgcatgcgttaatttcgctatggttccagctgtttatattttttatcctgaaacctctggtaggtcactcgaagacatagacataatttttgaacattccaaccctaagactccttgggacgttatctcactttccagaaactataaaaaattggactataaagaatcagacctctacgaaagaaaagttttagtcgaatcgatagaataa

SEQ ID NO: 258 - protein, 535 aa, Debaryomyces hansenii
MPVSIEKPENLENPTLNSSSLESLNQSRKTFVGLRGEALYKMVAFVASIAFMLFGYDQGVMSSLLTLPSFLETFPEINVFENKSNSTLQGLVVAIYEIGCMCGALFAMVYGDNFGRRKMIWIGAATMTVGAVLQCSAFGLPHLIVGRIVTGIGNGFLTATIPMWLSECAKPERRGALNMISAALNIFGVALSYWVDFGFYFVKGSASWRFPIAFQIVFALFMMSVIFLMPESPRWLVKKNRIEEAKEVFAVFAEVETNHTFVLAKIKEIKDLSMKEDAEFSLKRLISFGPNKHFHRTMLAAFCQIMQQICGINLITYYAGTIYEDYLNMDPIPARILAACNGTEYFLAACLSYFLIERVGRRNLMLICAAGQSATMAILCGSGWAADNGDTKAAISAAVFLFVFNSFFAVGWLGVLWLYPAEIAPLEIRAAVNGLSTACNWAFTFLIVMITPICFAHIGAYTYAIFACVNFAMVPAVYIFYPETSGRSLEDIDIIFEHSNPKTPWDVISLSRNYKKLDYKESDLYERKVLVESIE

SEQ ID NO: 259 - DNA, 1764 bp, Debaryomyces hansenii
  CDS (1)..(1764)
atgagcaaatctcaactgtttatttcactgcaatcttcacaaaaattggatacatcttctatgacacagtcagtagtaagtgaaccacgtcgcctggtattgaataagattattggcggctttaagttcgaaaaagttgaagatagacccaccccttcggaagtctataattggagagtatatggaacggctcttcttgcatcatcggcagctataattattggttatgatggtggatttattggaggcactgttgccttaccatcttttaaatctgagtttggccttgataaaatgtcagagagtgaagcaggagatataatttctaatgttatttcagtttttcatgcgggatgtttcttcggagcattaatttcatatcccttttcattctatttgggtagaaggctttcgttgatcataagtgccacagcaatcacaatagggtcggctattatgttggcagctctgtcaaaaaatggacttgggccaatttatgcaggtagagtaatagctggtttggcagttggtttttctacaaacctaacaccagtgtatttgagtgagatttcaccacctgcgattagaggtagagtgattgcgttatatgaaattggttggagagttggtgatttagtgggtttttggattaactatgggattgattctcatatgggtccttccaaaacgcaatggtttattccttttgctgtccaattaattccaagtggtattttttttgctggtagtgttattatgaaagagagtccaagatggttatacagtgtaggcaaacatgatcaagctattaagaatttaaaatggtttagaaatttgccagaagatgatgaatatatggtttatgaggttaatcaagttaaggaatcaatagaatcacaaaagctccatattggtctcaaattatgggacccatttaaacaagtattcttcaaagatcacaaaattttatttagattgctcatcacctgttcgttatttttgtttcaaaatttcttgggaatccaatctatcaattattactcccctattatctttgctaatttaggggtcaaaggaacaaatgccacattattctcaacaggtatgtttggtgtcgtcaaatttgtttgtacctttatctatattttgtttattgttgatacttttggcagaagaaaagcattcatggtttcgtccacagtgtgttctatttgtttctggtacatcggtgcttatttgaaggttaatgatccttctcaaccaggagttcaagctggcccaggtggcactgctgcgattgttatgatgtacttctggattgcgtcttttattttagcttggtctggtggtccatttgttgtcggaagtgaagtattcgatcagaatattagatcatttgtccaggcaatcaatgctgctatttcttggattcctattttcataatgtcaaggtttacaaccaaaatgattgacaaaatggaatacggcatttactttttctttgcatctttggcagcattgtctgttccattcgtatttttctgtgttcctgagactaaaggtattgcattggaggatatggataaaatattcgacagatcattaccagctcgtaaggcgcacaaggtcgtccttggtcaagttagagccaatgcaattagtcaattagagggacatagaggactttacaaaatggacactaacaaatcaaatgaaattcaaaatattgaggatttagagttaatggtcaaaaacgagaagtga

SEQ ID NO: 260 - protein, 587 aa, Debaryomyces hansenii
MSKSQLFISLQSSQKLDTSSMTQSVVSEPRRLVLNKIIGGFKFEKVEDRPTPSEVYNWRVYGTALLASSAAIIIGYDGGFIGGTVALPSFKSEFGLDKMSESEAGDIISNVISVFHAGCFFGALISYPFSFYLGRRLSLIISATAITIGSAIMLAALSKNGLGPIYAGRVIAGLAVGFSTNLTPVYLSEISPPAIRGRVIALYEIGWRVGDLVGFWINYGIDSHMGPSKTQWFIPFAVQLIPSGIFFAGSVIMKESPRWLYSVGKHDQAIKNLKWFRNLPEDDEYMVYEVNQVKESIESQKLHIGLKLWDPFKQVFFKDHKILFRLLITCSLFLFQNFLGIQSINYYSPIIFANLGVKGTNATLFSTGMFGVVKFVCTFIYILFIVDTFGRRKAFMVSSTVCSICFWYIGAYLKVNDPSQPGVQAGPGGTAAIVMMYFWIASFILAWSGGPFVVGSEVFDQNIRSFVQAINAAISWIPIFIMSRFTTKMIDKMEYGIYFFFASLAALSVPFVFFCVPETKGIALEDMDKIFDRSLPARKAHKVVLGQVRANAISQLEGHRGLYKMDTNKSNEIQNIEDLELMVKNEK

SEQ ID NO: 261 - DNA, 1839 bp, Debaryomyces hansenii
  CDS (1)..(1839)
atggttctgattagccaaccaaaacaagatatgcaatcagttgaatctagagaagtagagcatccaaagcatgaaccttcgaccgttaccaaggatcatgctctgagttcttggacgtctaagtttagatggaaggtacaagatgatcatgcgcctaaagagatctataattggagtttgttcctttcggtcactgtatttggtattcttggtgccgcaagaggttatgatgaaggttgtatttcaactgcagtttcccaactttcgtttagagaacgttttggattcaacgatccaaataaaacggtggatgacatcgcagaactaagctcgaatattaaagctatggttcaattgggatccatcggtggagctcttattgctatgtatgctgttgataaacttggtagggttaggtctttacaagcagcttgtttgttatggatcacaggtgcaattatacaaattacctcaggaaacgttggtcagttgtatgctgggagattaattgaaggacttgctattggacaaactaccactattggacctacatatatgtcggaggttgcacctaaggctatcagaggactttgtggatgtgtgtttgctggtgctgtatatatgggtattatgatttcatattttgcaaattatggtgcagctttgcatatgtcacccgactcaaatcagcaatggattgttcctacttcgatcaagatcccattagcaggtttaatattcgttggatcgtttctcttctgtgtcgaaagtccaagatggctattgaaggtcaataagccagataaagcagcaaagaatttatcaaagttaagaaatttacctacagaccacccatatgttttaggtgaaatctccgatattaatgaacaaattaatgctgaaaacgaagctaccgaaggaaataccatattcgctatgatcaaggaaatattctgcgttaaatcgatcagatatagattttttgctgttgcttcattgacacagcttttaggtcaatggtctggtgcaaatgctgtgacaatttatgccccagaactcttttcattaatcggagcagttggtatcgaggaattgaagatgactgctattttaggtgttgtcaagtttgtatctgcttatttgagtgcattctttattattgatttcttaggtagaagaaaggcactctacattggtattataatccaaatgctttccattttatattttgctatattcttaacaattgttcctgaggctagcgaaggagctgacttgactggatcaaggggacgggctggaaagggagctatggcggcgttgtatttgtcaggagttggttggactatgggtttcaattcgattcaatacttattaggctcagaaatttttccattgcatattcgttcgttcgctcagtctgctatcatggttttacatttcgctaatcaatacggtaattcaaaggcattacctaagatgatgcttactatgaacaattatggtgctttctacttctttttcgctgttatgcttgtctctttggtctgggcatggttctttattccagaagttgctggccgttctttggaaagtatggaagaaatcttcaatttaccgtggtatcttattggaagaaagggggcagaattatgtccagattactctgaaatcaataagataacacataatgacgatggacatggtaatgcctacgatggtgaaattaattatgatttagaaaagtctaaggtatcgcaagagtttatcgaagataatggacttatgagaaaaggttcaatcgatgaatatgataagaactcaatcaagggtaaatga

SEQ ID NO: 262 - protein, 612 aa, Debaryomyces hansenii
MVLISQPKQDMQSVESREVEHPKHEPSTVTKDHALSSWTSKFRWKVQDDHAPKEIYNWSLFLSVTVFGILGAARGYDEGCISTAVSQLSFRERFGFNDPNKTVDDIAELSSNIKAMVQLGSIGGALIAMYAVDKLGRVRSLQAACLLWITGAIIQITSGNVGQLYAGRLIEGLAIGQTTTIGPTYMSEVAPKAIRGLCGCVFAGAVYMGIMISYFANYGAALHMSPDSNQQWIVPTSIKIPLAGLIFVGSFLFCVESPRWLLKVNKPDKAAKNLSKLRNLPTDHPYVLGEISDINEQINAENEATEGNTIFAMIKEIFCVKSIRYRFFAVASLTQLLGQWSGANAVTIYAPELFSLIGAVGIEELKMTAILGVVKFVSAYLSAFFIIDFLGRRKALYIGIIIQMLSILYFAIFLTIVPEASEGADLTGSRGRAGKGAMAALYLSGVGWTMGFNSIQYLLGSEIFPLHIRSFAQSAIMVLHFANQYGNSKALPKMMLTMNNYGAFYFFFAVMLVSLVWAWFFIPEVAGRSLESMEEIFNLPWYLIGRKGAELCPDYSEINKITHNDDGHGNAYDGEINYDLEKSKVSQEFIEDNGLMRKGSIDEYDKNSIKGK

SEQ ID NO: 263 - DNA, 1842 bp, Debaryomyces hansenii
  CDS (1)..(1842)
atgctgcacgagcaaaaagacttggcagaagtgtcaaaaattaatactaaagaacaaattgttgagcatccacattctacagcgaccaagcaccacgcgcaagattcatgggcgtctaagtttaggtggaagataaaagacgaccatgctccacctgaaatctttaactggactttgtttctttcggtctttgttttcggtatcttagggtcggctagaggttatgatgaaggtaatatctctgggtcagtcgcgcaaatttcgtttcagaattattttggtttcaatgatccaaataagtctgaagatgatgttgcaaacttgaaatctaatattacatccatggttcaattaggttctattggtggttgtattattgctatgtttgttgttgatagatttggtagaattagatctttacaagcagcttgcgttttatggatcgcagctgcaattattcaaatcacttcaacaaatgttggtcagttgtatgctggaagattaattgaaggacttgctattggacaaactaccactattggacctacatatatgtcggaggttgcacctaaggctatcagaggactttgtggatgtgtgtttgctggtgctgtttactttggtataatgatggcgtattttgcaaattatggtgcagctttgcatatgtcacccgactcaaatcagcaatggattgttcctacttcgatcaagatcccgttagcaggtttgatattgactggatcgttcgttttctgtgtcgaaagtccaagatggctattgaaggtcaataagccagataaagcagcaaagaatttatcaaagttgagaaatttacctacagaccacccatatattttaggggaaatctccgatattaatgaacaaatccatgctgaaaacgaagctacccaaggaagtaccatattcgctatgatcaaggaaatattctgcgttaaatcgatcagatatagattttttgctgttgcttcattgacacagattttaggtcaatggtccggagcaaacgctattacgatatattctccagaactttttgcattagttggagctgttggagttgaaaagttgaaatggactgctattttaggtgttgtcaagtttgtatctgcttacttcagtgcgttctttgttattgatttcttaggtagaagaaaggcactctacattggtattatgatccaaatgctttccattttatattttgctatattcttaacaattgtccctgaagctggagatgataatgtcaatttgactggatcaaaagaaagagccggaaagggagctatggctgcattattcttgtcaggagcaggttggactatgggtttcaattcgattcaatacttattaggttcagagattttcccattgaacattcgttcgttcgcccagtctgctatcatggttttacatttcgctaatcaatatggtaattcaaaggcattacctaagatgttgcttgccatggataactacggtgctttctacttttttgtcgctattatgattatcggcttgttatgggcatggttctttattccagaagttgctggccgttcgttggaaagtatggaagaaatcttcaatttaccgtggtatcttattggaagaaagggggcagagttatgtccagattactctgaaattaataagatcacatacagcgatgatggacatggtaatgcctacgatggtgaaattaattatgatttagaaaagtctaaggtatctcaagagtatgtcgaagataatggacttatgagaaaaggttcgaacgaagaagaagataataactcaatcaaggataaatcttaa

SEQ ID NO: 264 - protein, 613 aa, Debaryomyces hansenii
MLHEQKDLAEVSKINTKEQIVEHPHSTATKHHAQDSWASKFRWKIKDDHAPPEIFNWTLFLSVFVFGILGSARGYDEGNISGSVAQISFQNYFGFNDPNKSEDDVANLKSNITSMVQLGSIGGCIIAMFVVDRFGRIRSLQAACVLWIAAAIIQITSTNVGQLYAGRLIEGLAIGQTTTIGPTYMSEVAPKAIRGLCGCVFAGAVYFGIMMAYFANYGAALHMSPDSNQQWIVPTSIKIPLAGLILTGSFVFCVESPRWLLKVNKPDKAAKNLSKLRNLPTDHPYILGEISDINEQIHAENEATQGSTIFAMIKEIFCVKSIRYRFFAVASLTQILGQWSGANAITIYSPELFALVGAVGVEKLKWTAILGVVKFVSAYFSAFFVIDFLGRRKALYIGIMIQMLSILYFAIFLTIVPEAGDDNVNLTGSKERAGKGAMAALFLSGAGWTMGFNSIQYLLGSEIFPLNIRSFAQSAIMVLHFANQYGNSKALPKMLLAMDNYGAFYFFVAIMIIGLLWAWFFIPEVAGRSLESMEEIFNLPWYLIGRKGAELCPDYSEINKITYSDDGHGNAYDGEINYDLEKSKVSQEYVEDNGLMRKGSNEEEDNNSIKDKS

SEQ ID NO: 265 - DNA, 1638 bp, Debaryomyces hansenii
  CDS (1)..(1638)
atgggatacgaagataaattactagggccagccttaaagtttagaaacttcttggacaaatttccgaacatccataatgtctatattgttgttggtatttcttgtatatctggtatgatgtttggcattgatatttcttcaatgtctttattcattggagatgataaatatttagactatttcaattcaccagattctacacttcaagggtttattacagcatccatgtctttagggtctttctttggggccttattttccgcatttatatcagaacctttcggtagaagaatgtcgttgatgttctgtgcatttttttggtgtgttggagctgccattcaatcatcgtcacagaacgtcgtccagttaattataggtcgttttatttctggttttggtgttggatttggatcctcagtagccccagtttatggtacagaattggcaccaagaaaaataagaggattaattggtggattatttcagctttcggtcactttgggaattttggttatgttctatgtttgttatgcattacattatatcaatggtgtggcttcttttagattatcttgggggttacaaatagttcctggtcttcttttgttcattggctgttttttcatccctgaatcacctagatggttagcaaagcaaggctgttgggaggaggctgaatacattgtggcaatgattcaggccaaaggcaatagggaagatcccgatgtcatgattgagattactgagatcaaagatcaaattttgacagaggaaaatattaaggctttcacttatgcagatttattcaagcgcaaatatctccttagaactgtcaccgcaacatttgctcaaatatggcaacaattaacgggtatgaatacattaatgtattatattgtttatgtttttgatatggctggctatcagggcgatgcaaatttaattgcatcttcaattcaatacgttctttttttcgttatgactgccccttcattatatttaatggataaacttggtagaaggcccattttgttaagcggtgctgcattcatgatgatatggcaattcgcagtcggtggtttgctttccacttatgctgagcccaccaatgatgttggtggaaatgatactgtcagattaaggatcccagctgataactcaaccgctgccaagggtgtaattgcatgttgctatttgtttgttgtatcatttgcatatagttggggtgtttgtatctggatgtattgtgctgaagtttggggtgatagcgcctcaagacaaagaggggcctgttttacaacttcagctaattggatttttaacttcgcgatcgcaatgtttaccccctctgcgttcaaaaacattacttggaaaacatacatgatttttgctacgttctgcggttgtatgttccttcacgtatttttctttttcccagaaactaaaggtaaaagattggaggaaattggccaaatgtgggatgaaggaattccagcatggagaacagccgcatgggagccatctattccattcttatctgataatgacttgcgtgaaaagctagaagtaaaacacgtcgaagattcaaactccagtaattcggatgctgaaaagcctagtgctgtccatattgcttag

SEQ ID NO: 266 - protein, 545 aa, Debaryomyces hansenii
MGYEDKLLGPALKFRNFLDKFPNIHNVYIVVGISCISGMMFGIDISSMSLFIGDDKYLDYFNSPDSTLQGFITASMSLGSFFGALFSAFISEPFGRRMSLMFCAFFWCVGAAIQSSSQNVVQLIIGRFISGFGVGFGSSVAPVYGTELAPRKIRGLIGGLFQLSVTLGILVMFYVCYALHYINGVASFRLSWGLQIVPGLLLFIGCFFIPESPRWLAKQGCWEEAEYIVAMIQAKGNREDPDVMIEITEIKDQILTEENIKAFTYADLFKRKYLLRTVTATFAQIWQQLTGMNTLMYYIVYVFDMAGYQGDANLIASSIQYVLFFVMTAPSLYLMDKLGRRPILLSGAAFMMIWQFAVGGLLSTYAEPTNDVGGNDTVRLRIPADNSTAAKGVIACCYLFVVSFAYSWGVCIWMYCAEVWGDSASRQRGACFTTSANWIFNFAIAMFTPSAFKNITWKTYMIFATFCGCMFLHVFFFFPETKGKRLEEIGQMWDEGIPAWRTAAWEPSIPFLSDNDLREKLEVKHVEDSNSSNSDAEKPSAVHIA

SEQ ID NO: 267 - DNA, 1638 bp, Debaryomyces hansenii
  CDS (1)..(1638)
atgggatatgaagaaaagttggtcgcaccagctctaaaactaagattattcttagataaacttccaaacatttataatatttatgtcattgctactatttcgtgtatttcggggttgatgttcggtatcgacatttcatcgatgtcggcgttccttagtaatgacgcttaccttaaatattttggtacccctgaacctgatatgcaaggattcattactgctgctatgtctcttgggtcattctttgggtctcttgcatcggcattttgttcagagccatttggtagaagagcttcattgttgctttgtggattcttttggtctgttggggctgcaattcaatcttcatcacagaatgtcgcccagttaattattggtcgttttatttctggttttggaattggtttcggctcatctgtggcacccgtgtatggatcagagttggcacctagaaaaattagagggttaattggtggtcttttccaactttcagttaccttaggtattttgattatgttctatatctgttacgggttaggtaaaatccaagccgtcggctcattcagaactgcgtggggtttgcaaattatcccaggattgatcttaatacttggatgtttctttattccagaatcacctagatggttagccaaacagaactactgggaagaggcggaggacattgtcgctagagtccaagctaaaggtaacagagaagaccctgaagtattaattgaaatggctgaaattagagaccagattctgacgttagacaaagttaagtcttttacttatattgatttattcaaaaagaagtatcttcttagaactgtaacggcaatatttgctcaaatttggcaacaattaacaggtatgaacaccttaatgtattatattgtctatgttttcgaaatggctggttatcatggtgatgcaaatttggttgcctcttcaattcaatattgtatcaattttgccatgactattcctgcattgtacttaatggataaggtcggtaggagaccagtgttgttaactggagctgcgctcatgatggcctggcaatttgctatagggggcttgcttgccacttatgctgaacccaccgatatttttgggggtaataataccgttaaaatcagtatcccagaagatgaatctcctgccgccaaggctgttattgcatgttgttacttattcgttgtttcatttgcgtctacttggggtgttggtatctgggtttactgtgctgaagtctggggtgatagtgcctcaagacaaagaggtgcgtgtgttgcaactgctggtaattggatttttaatttcgcaattgcaatgttcactccgcacgctttcagtactattacttggaaaacatacatgatttttgctactttctgtgcatgtatgtttcttcatgttttcttctttttccctgaaactaagggtaaaagattggaagaaattggtcaaatgtgggacgagcatgttccagcttggaagtctgcttcgtggcaaccacacgtaccactcgtttcagataatgaaatacacgggaagatggattctgcgcatgatgaacattcatctcgttcggagtctactggagaaaaggtggtcgcagatcacattgcttga

SEQ ID NO: 268 - protein, 545 aa, Debaryomyces hansenii
MGYEEKLVAPALKLRLFLDKLPNIYNIYVIATISCISGLMFGIDISSMSAFLSNDAYLKYFGTPEPDMQGFITAAMSLGSFFGSLASAFCSEPFGRRASLLLCGFFWSVGAAIQSSSQNVAQLIIGRFISGFGIGFGSSVAPVYGSELAPRKIRGLIGGLFQLSVTLGILIMFYICYGLGKIQAVGSFRTAWGLQIIPGLILILGCFFIPESPRWLAKQNYWEEAEDIVARVQAKGNREDPEVLIEMAEIRDQILTLDKVKSFTYIDLFKKKYLLRTVTAIFAQIWQQLTGMNTLMYYIVYVFEMAGYHGDANLVASSIQYCINFAMTIPALYLMDKVGRRPVLLTGAALMMAWQFAIGGLLATYAEPTDIFGGNNTVKISIPEDESPAAKAVIACCYLFVVSFASTWGVGIWVYCAEVWGDSASRQRGACVATAGNWIFNFAIAMFTPHAFSTITWKTYMIFATFCACMFLHVFFFFPETKGKRLEEIGQMWDEHVPAWKSASWQPHVPLVSDNEIHGKMDSAHDEHSSRSESTGEKVVADHIA

SEQ ID NO: 269 - DNA, 1620 bp, Debaryomyces hansenii
  CDS (1)..(1620)
atgtcaaagctaattccttcgcccaagatctcagaagagaaaatcgatcaagaactatctcaacttgtggaagaaaccgcagtttttcaacaaacaatcgagcacaagtataccaggtatgaggctattagagcgtaccctaggacatgcgtttatattttgatattattatgggttatgatattagttggttatgaaactcaggctggtggtatggtagtctctattcctacatttagacgtgattttggatattatttcgaaggtgattatgttttagatggtaaatggcaatcagcaatttctggtggcccgagtggatctgttgttataggcgggtttttaggctcctatatggcagattcaatcggtagaaagctcacacttttaatcgctgttggagcgacaattggatttatcgttcttgagtatgtttccactacgattgaggtattctttgctggaaaattcttaaatgcactctctttaggaattattgctgcagtatctacgtctttgattgctgagattacccctttagctttaagaggattatccgttgctgcaattagtttgtcgttatctttgggcccatttgtctgttatttgattgcaaatacaacatcgactcgagatgatagaatggcatataggagcttgtttttgagtcaatgggcatttagtggaacatcttttatcatgttattttgtattccagaatccccgtactattatgtgttaaaaaatgcagacgaaaaggctctaaaacaattgagaaaattgtataaaggtgaagcactcgcaaaacatcagttaactgtcattaaaaaaacagtagaagaagctagacatactactatatcgtcatcttttgtggattgctttaggggaattaacttaaaaagaacatttattgcaatatcacctttcattatgcagcctatgagtggtgtcgcctacgttggttcatactctacttattttttccaattagctgggtataatactcacctgtcgtttcaaataagtgttggtcaacaagctttgtctattttaggttgcattgcttcatggtttatccttgatagattcggaagaaggcatgttatgctatacggtatgatttctttatttgtacttaatgttattactgcaggcttgggttgcagcaacaaagaaagctacttaactggtgcgtccgcattcatgactatgtataactttttttacaacccaagcatcggtcccctttcttatgttataaatgcagaaaatcctagttctcaactaagggttaaaactatctcaattgggttggctgcgaataatggtttacaatgtatgtggcaattcgttttgcctttcatgttcaatccagatcaagcaaatatgggatctaagattaatttcatatttgctgcttgttgctttattagtatattctgtttttatttctatttaccagaaactgcaaacaggtcatttgatgaaattgatgaaatgtatataaaaaaggtcccagccaggaagtttaggaattttatttcagatacgcaaattaaagctactgaacaaaatgatgagaaaaagggactcgaagttgaacatattgaagcttga

SEQ ID NO: 270 - protein, 539 aa, Debaryomyces hansenii
MSKLIPSPKISEEKIDQELSQLVEETAVFQQTIEHKYTRYEAIRAYPRTCVYILILLWVMILVGYETQAGGMVVSIPTFRRDFGYYFEGDYVLDGKWQSAISGGPSGSVVIGGFLGSYMADSIGRKLTLLIAVGATIGFIVLEYVSTTIEVFFAGKFLNALSLGIIAAVSTSLIAEITPLALRGLSVAAISLSLSLGPFVCYLIANTTSTRDDRMAYRSLFLSQWAFSGTSFIMLFCIPESPYYYVLKNADEKALKQLRKLYKGEALAKHQLTVIKKTVEEARHTTISSSFVDCFRGINLKRTFIAISPFIMQPMSGVAYVGSYSTYFFQLAGYNTHLSFQISVGQQALSILGCIASWFILDRFGRRHVMLYGMISLFVLNVITAGLGCSNKESYLTGASAFMTMYNFFYNPSIGPLSYVINAENPSSQLRVKTISIGLAANNGLQCMWQFVLPFMFNPDQANMGSKINFIFAACCFISIFCFYFYLPETANRSFDEIDEMYIKKVPARKFRNFISDTQIKATEQNDEKKGLEVEHIEA

SEQ ID NO: 271 - DNA, 1533 bp, Debaryomyces hansenii
  CDS (1)..(1533)
atgataagcttcaagatgtttgggacttctaaaataatatgctacggaaaaaatttacggcttttgattacattttgttcctgcactggctttttattgcttggttacgaccagggcttaatgggtaccattataggagcagataataggttcggtcgtgatttcaaccatcctgactctacggtacaaggtttattgacatccgtatacgatttgggttgtgttggggggtcaattatatgtttttttattggcgaaaagtatggtagaagatcaatgatgttttgtggggggttgattatgataataggaactatcatattagcagcatctcagtcaagaggccaattttatgcaggtagaattattactggtattggaaatggtttcaattcgtcaactatacctgtatatcagtctgagtgtgctctagcttctaacagaggctccatgctaacttggcaagcagttgtgacaattttcggtgtagtaatagcctactgggtagggtatggtacatcttatacagaaagtccttttcaatggaggttcccagtagcatttcaaggtatttttgcaattagtcttactttagaaacattcttgttaccagaaacaccccgttggttggtaaccaaaaaccgtaaagcggaagctacgcaggttttggctgctattttggataaggatgtgaatgatcgggtagtcatttatgaaaaagatgaaatagagaaagcggttgaattagaaggcgccggaggcccttttcaattcaaagaactttttggaggtggtgacattcaaaattttagaaggttactattgaccataggtataatgataatgcaacaatttactggttcaaatatgataaattactatgccccagttgtttatcaatctacaatgaaattaagtagaaacacttcactaatacttgctggctgcacggaaattgtatatcttgcagcgtctttcttcccactttgggccgttgaaagatttggaagaaggccattactcttgtactcttcagcgggactatctttttgttttatagttgtttccattttgttgtctattgggacatatgggtgtggtgtgggtgctgcatgttttatctttatataccaaatttttatgggagttggttggttaccagtaccttggttttacccttcagaaatcaacgttacaaggctaagatctagaaatcaagctatagggtcagcatttaactggttgtcagtttttgcggttgtacaaattactcctatatccattaataatattggttggaagacttttataattttcgccattttgaacgctgtttggatacctataatctattgcttttatccagaaactaagggactagaattagaagatattgatcatatcttcgagaaacctggtattactaggggagtattctcaagtagaggtaagcctattgacccaaacgaaaaacattcttatgaggatagtattattgagaaggaatcaataatacacattgaaaaagtttaa

SEQ ID NO: 272 - protein, 510 aa, Debaryomyces hansenii
MISFKMFGTSKIICYGKNLRLLITFCSCTGFLLLGYDQGLMGTIIGADNRFGRDFNHPDSTVQGLLTSVYDLGCVGGSIICFFIGEKYGRRSMMFCGGLIMIIGTIILAASQSRGQFYAGRIITGIGNGFNSSTIPVYQSECALASNRGSMLTWQAVVTIFGVVIAYWVGYGTSYTESPFQWRFPVAFQGIFAISLTLETFLLPETPRWLVTKNRKAEATQVLAAILDKDVNDRVVIYEKDEIEKAVELEGAGGPFQFKELFGGGDIQNFRRLLLTIGIMIMQQFTGSNMINYYAPVVYQSTMKLSRNTSLILAGCTEIVYLAASFFPLWAVERFGRRPLLLYSSAGLSFCFIVVSILLSIGTYGCGVGAACFIFIYQIFMGVGWLPVPWFYPSEINVTRLRSRNQAIGSAFNWLSVFAVVQITPISINNIGWKTFIIFAILNAVWIPIIYCFYPETKGLELEDIDHIFEKPGITRGVFSSRGKPIDPNEKHSYEDSIIEKESIIHIEKV

SEQ ID NO: 273 - DNA, 1665 bp, Debaryomyces hansenii
  CDS (1)..(1665)
atgaagatagtgataataagggacattatggatactagattgaatatgagtgataaggatatttctctagaaaactcgaggaatgattcggtgaagacacctaaaaatgtttatactctagcagatgttacacccaagtttgaaaaaatatggtttaaatatccttggttgttacaattgaatatttttcttttaggaggtattttggctcaggttacttctggatatgatggtagtatgatgaacaatttgcagacgcttccaagttggagaaattactttgatcaaccaacgggaagcattttaagtactatggctaatggtgttacaattggtaccttaatttcgattccatttacttggtttgtatgtgattattttggtagacggataacgattatgttcggctgtattgttgtcattataggtgcagcaattcaaggtggtgcggtgaattttggaatgttcacggccgcgagagtgctacttggtattggttcatgttttgcatcagcagctgcttcacccttgttggctgagacatcgtatccatctcagaggcctgtcgtgacagcgttgttgttagcatcatggccatttggatcttttgttgcttctgtagttacttggggcccttatcattcaagcatgaagtataataattggtcctggagaataccctctattttgcaatgtgctttccctgcaattgaattattacttgctttttttggtccagaatcaccgagatggttgatcgacaaaggcagaagtgatgaagctgaagctttttttataaaatatcatgctggaggcgattcgagtagtccgttagtgagttatgaaatggccgaaataaaagctattatcgaacaagaaaaggtccaaaaaaagagcaaatggagtgaatggttcaggacaaaacaacgtctccgtaggttgtttattgttttggcagtcccagcaatggcacaactatgtggaaatgcacttatttcatattacttgcaaatagttttgaccaatattggtatcactgaaacaaatgaccaacttaaaattaatattggaatgacagtctacggtttagtatggtctgttggttgcgcaacatttgtcgacaagttcaaacgtaagcatacttttattggaggctatatcctaatgtgtattacatatgttgtttggactatattatctgcaattaatcaacagggtgatttcgaaaataagggtctaggaagaggtgtcgttgctatgatttatcttttcctggggttttatcatattgtatctcctgtatctatgactttcgttatggaagtttgccctttccatttgagagcacaaggagctactctctatcaactttctggaaatgtaattggtttctttaataattatgtgaacaacattgcgatgcaggctataacttggagatactatattgtatggtgtatctggctagtggtgcaaatgaacatcgtatactggatattcccagaaactaaaggtttgggtttagaagaagttgcccaagtattcggagaggatgtaaccgccggctacaaggctggtgatcatgcacttgaatacggaattgaggaggtaaacaaagatgatgtgtctgttgaacacattgaagagaaagtagataaaaactaa

SEQ ID NO: 274 - protein, 554 aa, Debaryomyces hansenii
MKIVIIRDIMDTRLNMSDKDISLENSRNDSVKTPKNVYTLADVTPKFEKIWFKYPWLLQLNIFLLGGILAQVTSGYDGSMMNNLQTLPSWRNYFDQPTGSILSTMANGVTIGTLISIPFTWFVCDYFGRRITIMFGCIVVIIGAAIQGGAVNFGMFTAARVLLGIGSCFASAAASPLLAETSYPSQRPVVTALLLASWPFGSFVASVVTWGPYHSSMKYNNWSWRIPSILQCAFPAIELLLAFFGPESPRWLIDKGRSDEAEAFFIKYHAGGDSSSPLVSYEMAEIKAIIEQEKVQKKSKWSEWFRTKQRLRRLFIVLAVPAMAQLCGNALISYYLQIVLTNIGITETNDQLKINIGMTVYGLVWSVGCATFVDKFKRKHTFIGGYILMCITYVVWTILSAINQQGDFENKGLGRGVVAMIYLFLGFYHIVSPVSMTFVMEVCPFHLRAQGATLYQLSGNVIGFFNNYVNNIAMQAITWRYYIVWCIWLVVQMNIVYWIFPETKGLGLEEVAQVFGEDVTAGYKAGDHALEYGIEEVNKDDVSVEHIEEKVDKN

SEQ ID NO: 275 - DNA, 1749 bp, Debaryomyces hansenii
  CDS (1)..(1749)
atgtcacgcttatcttttatcgttaaaaacgaagtggaacctaatattgaaattgagaacaaaactaaatatgaacaggtgaatttcgaagtagatcctaccgctgataaggatattaatgattatatcgaaaagtttctagacatttcggataatgcaagaaataacgacaagcaagaaaaagagatgtcactacttgagggattgaaaacatatcccaaagcagctgcatggtcagtgattctatcaacagctttggttatggaaggttatgatacttcgctcatgggatcattatatggtatgcctgcatttgctgagaaatttggtatgtttgagccatcttctcaatcgtatcaaattccggcaaaatatcagaccatcatgggtacttgtggtaatgctagttctataattggactctggtttgctggtattcttgcagataggtttggatatagaaaaactattatagctaacttgatcttggttgcaatttttattttcattgtttttttcgcaaagaatattggtatgttaatggcaggtaacattttactaggctttccctggggtgcctttcagacattatcagttgcttatgcttctgaagtatgtcctatggttttgagaatttacttgacgacatattccaatatttgttggatttttgggcaattactctcagctggtgtaatgcgggcatttgttactagcacctcagagcaatcctataaagtaccatttgctattcaatgggtatggcctgttccaattatcatcggtgtattttttgctccagaatcaccttattggttagtcaagaatgacaaatataaagaggccaagagatcgattgagaggctcattactgaaaacaaaaatgtggacaaaaatatactttctgaagcgatgttacaaaaaatgcaaatgacagttaaaggtgagcagcaagaaaaaaagctaccttcttatttggaatgtttcaaaggtgtagagcttcgtcggacacgaattgctgcattgacttggctaactcaaaacctatgtggcgccactctcttgagttattcgagctacttctatattcaagcaggtatggctccagagatgtcatttacatttacaattattcaatttgcacttggtattgtaggcactattgggtcttggtttttgtctaagagatttggtcgctttacaatttattttggagggctttgtgctttagctgtaatattgatggtgataggcgggcttggctgctcaactgataagaattctatgtggggtgttggcactcttctaattatttacgttatggtctacgatttaactgtcggtccgttatgttattgtattgttgctgaaataccttctgttcgtcttcgcgcaaagagtattattattgctagaaacctctacaatatttctggaatagttttgagtatacttactccttatatgcttaatccaggagcttgggattggctggcaaaggttgggtttttctggtcaggattcactattgtttgtgcagtctggtgcttttttgatttaccagagaccaagggaaaaacttttgcggatcttgattatcttttccaacaaaatatcaaatcaagagacttcaaaaatacggaagcttctgtttttgatgccgagagctacatccataaactaggagatgatgggataaagcagcttgttgagcagaatgagtttgccaataatactggaaaagtataa

SEQ ID NO: 276 - protein, 582 aa, Debaryomyces hansenii
MSRLSFIVKNEVEPNIEIENKTKYEQVNFEVDPTADKDINDYIEKFLDISDNARNNDKQEKEMSLLEGLKTYPKAAAWSVILSTALVMEGYDTSLMGSLYGMPAFAEKFGMFEPSSQSYQIPAKYQTIMGTCGNASSIIGLWFAGILADRFGYRKTIIANLILVAIFIFIVFFAKNIGMLMAGNILLGFPWGAFQTLSVAYASEVCPMVLRIYLTTYSNICWIFGQLLSAGVMRAFVTSTSEQSYKVPFAIQWVWPVPIIIGVFFAPESPYWLVKNDKYKEAKRSIERLITENKNVDKNILSEAMLQKMQMTVKGEQQEKKLPSYLECFKGVELRRTRIAALTWLTQNLCGATLLSYSSYFYIQAGMAPEMSFTFTIIQFALGIVGTIGSWFLSKRFGRFTIYFGGLCALAVILMVIGGLGCSTDKNSMWGVGTLLIIYVMVYDLTVGPLCYCIVAEIPSVRLRAKSIIIARNLYNISGIVLSILTPYMLNPGAWDWLAKVGFFWSGFTIVCAVWCFFDLPETKGKTFADLDYLFQQNIKSRDFKNTEASVFDAESYIHKLGDDGIKQLVEQNEFANNTGKV

SEQ ID NO: 277 - DNA, 1737 bp, Debaryomyces hansenii
  CDS (1)..(1737)
atgtttaagcaggagaatggaaaaaaactagaatcaaccagacaactggtcgataatggttctaattcaagcaacaatactgctaacgggtcctttacggcgaaggataaaattgacagtaatgaccttgaaaatcatgaaactccagaagatccagatcaaattccatctacaaacgaaattgttgaaaatttacctaccttacctgaaaaatctactaaagattatttatctacatcgtttttctgtttattgattgctttcggtggttttgtctttggctatgatacgggtacgatttctggctttgtgaatatgacggactttaaaaggaggtttggtactcttgataatggagaatatattttaaccaatattagaacaggtcttattgttgcgatttttaatattggttgtgcagttggtggtatttttctctccaaagttggtgacatatatgggcgtcgtgttggccttatgttttcgatgcttatttatattgttggtactattattattattgcagctagcgataaatggtatcaagtggttattggaagggctattactggattggctgtcggctgtgtttcagttctctccccaatgttcattggagaatctgcaccaaaggtattaagaggtacgttggtttgttgcttccaactcttcattactttaggtattttcttagggtattgcaccacctacggtactaaggtatatgatgattctcgtcaatggagaattccactgggcttatgttttgcatgggcaatctttttaactattggtatgatttgtatgccagagtcacctcgttatttgattgaaaaaaacaaaattgaagaagctaaaaaatctatcggtatttccaataaggtatcggcggagcatccagctgtctacactgaaattcaattaatccaagcaggtattgatagagaaaagttggcaggttcagcttcttggactcaattaattactggtaaaccaagaattttcagtcgtgttatcactggtattgtcttgcagtcgattcaacaattaacaggtaacaattatttcttttactatggtacgactatttttcaagctgttggattaaatgattcttttcaaacttctattattttaggtgttgttaatttttcttcaacttttgtcggtatttacagtattgaaaaattaggtagaagagtctgtttgttgactggttctgttgcctgtagtatctgtttcatcatttattcggtattgggatccgtcgctttgtatcctgagggctatgatggtccaacagataagccatcaggtaatgcgttgattttcattacctgcttattcattttctcattcgcctcgacttgggctggtggtgtctataccatcgtatcagaaatttacccgttgaggattagatcaaaggcaatggctgtagctactgcggcaaattggatctggggtttcttgatttcatttttcacacctatgatcactgctgcaattcatttctactatggttttgttttcacaggttgtttaattttctcattcttttatgtttacttctttgtttatgaaactaaagggttatcattggaagaagttgatgaattgtattctctgaaaataccagcatggaaatcttcagactgggttccaccatctacagataatatggcacatgataccgggttcgcatccgaagcgaaaccttctgatgaacaagtatag

SEQ ID NO: 278 - protein, 578 aa, Debaryomyces hansenii
MFKQENGKKLESTRQLVDNGSNSSNNTANGSFTAKDKIDSNDLENHETPEDPDQIPSTNEIVENLPTLPEKSTKDYLSTSFFCLLIAFGGFVFGYDTGTISGFVNMTDFKRRFGTLDNGEYILTNIRTGLIVAIFNIGCAVGGIFLSKVGDIYGRRVGLMFSMLIYIVGTIIIIAASDKWYQVVIGRAITGLAVGCVSVLSPMFIGESAPKVLRGTLVCCFQLFITLGIFLGYCTTYGTKVYDDSRQWRIPLGLCFAWAIFLTIGMICMPESPRYLIEKNKIEEAKKSIGISNKVSAEHPAVYTEIQLIQAGIDREKLAGSASWTQLITGKPRIFSRVITGIVLQSIQQLTGNNYFFYYGTTIFQAVGLNDSFQTSIILGVVNFSSTFVGIYSIEKLGRRVCLLTGSVACSICFIIYSVLGSVALYPEGYDGPTDKPSGNALIFITCLFIFSFASTWAGGVYTIVSEIYPLRIRSKAMAVATAANWIWGFLISFFTPMITAAIHFYYGFVFTGCLIFSFFYVYFFVYETKGLSLEEVDELYSLKIPAWKSSDWVPPSTDNMAHDTGFASEAKPSDEQV

SEQ ID NO: 279 - DNA, 1584 bp, Debaryomyces hansenii
  CDS (1)..(1584)
atgggtttagaagataatgcgcttattagaaagtatgtcaatgtcggggaaaaaagggctgggtcagcatctatggggattttcgtaggtgccttcgcagctttcgggggtgttttgttcgggtatgatactggaaccatttcaggtatcatggccatgaactatgtcaaaggagaatttcctgccaataaggagagttttacgtcaaaagaaagttcgttgattgtttccatcttatcagcaggtactttcttcggtgcgttgttagcaccgtttatgtctgatactttaggtagaagatggtcattaattatttcaacattcattgttttcaacttgggagtgattttacaaactgtttcaactggtattccattactatgtgctggaagagctattgctggttttggtgttggtcttatatctgctgtcattccattatatcaatcagaagccactccaaaatggattagaggggctgttgtatcttgttatcaatgggccattactattggcttattgttagcggcttgtgttaaccaaggtactcataatagaaatgactcgggttcatacagaattccaattgctgttcaacttttatggtcgttaattttgggtactggtatgatcttcttgcctgacacgccacgtttctggatccacaaaggtaatgaatctgaagctaagaaatcgttgaagattttaagaaaattaccacttgaccacccagacttaattgaagaatacgaagacatcaaagctgcttacgatttcgagtgttctttcggaaaatcgtcttggatggatctttttaccacaaggaataggcaattgaagagattatttaccggtgttgctcttcaagcatttcaacaattaactggtgttaactttatcttctattttggtacctctttcttcaagagtgctggtattgaaaacgaatttcttatttctttagccaccagtattgttaacgtaggtatgactgttccaggtatctttttaattgaattagtgggtcgtcgttctatgttgttgtggggtgctgttggtatgtcggtttctcaatttatcgttgctattgttggtattgccactgatagtgccgacgctaacaaagtcttgatcgcattcacttgtttcttcattgcattctttgcttctacctggggtccaattgcttgggttgttgttggtgagattttcccattaagaactagagctaagtccgttgcattatctgccgcttccaactggctttggaactgggctatcgcatacgctactccatacttggtagaagatggtaagggtaatgctaacttaggaacaaacgttttcttcatctggggtggatgtaactttctttgtattttgttcacttacgtcttcatttacgaaaccaagggttactctttggaacaaattgatgaattatatgaaaaagttccacatgcttggaaatctcgtggcttcattccttctgcccatgctttcagagaagatgctccagagtcaatcagctctatgggaaaggatatggaaaaagttactgaaattgaaaccacttcagtctaa

SEQ ID NO: 280 - protein, 527 aa, Debaryomyces hansenii
MGLEDNALIRKYVNVGEKRAGSASMGIFVGAFAAFGGVLFGYDTGTISGIMAMNYVKGEFPANKESFTSKESSLIVSILSAGTFFGALLAPFMSDTLGRRWSLIISTFIVFNLGVILQTVSTGIPLLCAGRAIAGFGVGLISAVIPLYQSEATPKWIRGAVVSCYQWAITIGLLLAACVNQGTHNRNDSGSYRIPIAVQLLWSLILGTGMIFLPDTPRFWIHKGNESEAKKSLKILRKLPLDHPDLIEEYEDIKAAYDFECSFGKSSWMDLFTTRNRQLKRLFTGVALQAFQQLTGVNFIFYFGTSFFKSAGIENEFLISLATSIVNVGMTVPGIFLIELVGRRSMLLWGAVGMSVSQFIVAIVGIATDSADANKVLIAFTCFFIAFFASTWGPIAWVVVGEIFPLRTRAKSVALSAASNWLWNWAIAYATPYLVEDGKGNANLGTNVFFIWGGCNFLCILFTYVFIYETKGYSLEQIDELYEKVPHAWKSRGFIPSAHAFREDAPESISSMGKDMEKVTEIETTSV

SEQ ID NO: 281 - DNA, 1674 bp, Debaryomyces hansenii
  CDS (1)..(1674)
atgactactgctgttggattagaagataattccaaagggaatattattactgttatgagtaaagatccgttagtgttttgcataattgcgtttgcatctattgggggtttactctttgggtacgatcagggagttattagtggtatagttactatggagtcatttgcggcaaaattccccagaattttttccgatcctgattataagggttggtttgtttctacatttttgttgtgtgcttggtttggttcgttgataaactctcctgttgttgatcgatttggaagaagggatactataagaatagcttgcgttgtatttgttatcggatctgtctttcaatgtgcaggtacgtcggttagtatgcttttcgctgggagagcagttgctggtatcggtgtcggacaattgactatggtagtcccaatttatatgtcggaattagctccaccttcagtaagaggtggtttagttgtaatacagcaattttcaataacaataggtattttgatatcattttggataaattatggcactcaatttattggaggaactaaatgtgctcctgaccaagattacaaaggcgatactttcgacccatacattgatgttcctcaaggtggttgttacggtcaaaaagatgcttcctggagaattccatttgggttacaaattgcaccagctttcattttaggtattggtatgtctttttttccaagatcgccaagatggctcttatcaagaaaaagagaagaggaggcatgggaggctttgaattatttgaggagaagaaataatcctgatatgattgatgctgaattcaatgaaattaaatcggacgtattatttgaacaaaaatataacgagaggaaatttcaaggaaaaacaggaatgtctttctttataacatcgtattgggatctagtctctaccaaatcaaattttaagagagtttttataggctctgcggttatgttcttccaacaatttattggttgtaatgcaattatttattacgcaccaacaatatttagtcaattaggaatggattccaacaccacagcattgttaggaacaggggtctatgggattgttaattgcctttcaactattcctgctatctttgcgattgacagatttggtagaaaaactttattgatggctggggcagctggaacttttgtttcgttggttatagtaggtgcaattgtcggcacatatggtgatactttatctaagcataaaactgctggtagagcggcaatagcttttatttttatatatgatttcaacttttcatatagctgggcacctattggatgggttttaccatccgaaatcttctctattggaatcagatcaaaagctatatccattactacttcatcaacatggatgaataatttcataattggtttggtcaccccccgtatgttggagacaatgaaatggggaacatatatcttttttgcagcatttgctataattgcatttgctttcacttggtttgttatcccagaaactaaaggagtacctttagaagaaatggatttagtttttggtgatttagatgcgttgcaagaaaagcaaaacttctctcgcatgaatgaattatcaaaaatggattcaattaaagctacaacagatatttcggaagcacattattctgattaa

SEQ ID NO: 282 - protein, 557 aa, Debaryomyces hansenii
MTTAVGLEDNSKGNIITVMSKDPLVFCIIAFASIGGLLFGYDQGVISGIVTMESFAAKFPRIFSDPDYKGWFVSTFLLCAWFGSLINSPVVDRFGRRDTIRIACVVFVIGSVFQCAGTSVSMLFAGRAVAGIGVGQLTMVVPIYMSELAPPSVRGGLVVIQQFSITIGILISFWINYGTQFIGGTKCAPDQDYKGDTFDPYIDVPQGGCYGQKDASWRIPFGLQIAPAFILGIGMSFFPRSPRWLLSRKREEEAWEALNYLRRRNNPDMIDAEFNEIKSDVLFEQKYNERKFQGKTGMSFFITSYWDLVSTKSNFKRVFIGSAVMFFQQFIGCNAIIYYAPTIFSQLGMDSNTTALLGTGVYGIVNCLSTIPAIFAIDRFGRKTLLMAGAAGTFVSLVIVGAIVGTYGDTLSKHKTAGRAAIAFIFIYDFNFSYSWAPIGWVLPSEIFSIGIRSKAISITTSSTWMNNFIIGLVTPRMLETMKWGTYIFFAAFAIIAFAFTWFVIPETKGVPLEEMDLVFGDLDALQEKQNFSRMNELSKMDSIKATTDISEAHYSD

SEQ ID NO: 283 - DNA, 1659 bp, Debaryomyces hansenii
  CDS (1)..(1659)
atggaaaaagataaagcagaggtacttcatattgaagaagctgtaaatgataattatgcagataaagctcttggtgttacaaatggagaaataatcgaggaggcaagagaggctactgataatgagcatgccttaactctaagaaaagcttttgcatcatataaacctgcaattctttggtcaatggtattttcagcaactattataatggaggggtacgataatattcttatgtcttcctttttcgcatatccttccttccaaaagaaatacggggttgatattggaaatggcgaatatgagcttctcaccaaatggcaaacggctcttggaacagcccctaatgttggaacaatccttggtgtatttgccaatggatatttaactgaaagatttggtcacagacaggtcattatggtgagtttaatatttatgtctgcatttatttttatcccattttttgcaccttcagtcgaagtattacttgttggtcaaatattatgtggtcttccatggggtgtttttgctacaatgggtccaacatattcatctgaggtttgtcctatggcattaagaggttaccttactgcgtatgttaatatgtgttgggctattggccaatttattgctgcaggagttcttaaggcttttgtcgctaatactactgaatggtcctataggataccttttgccattcagtgggcatggcctatacctctatttatattaacatgggctgctcctgattctccatggtggcttattagaaagggtagggttgaagaggctgaaagatctgtaaaaaggctttgttctaagtctattcaacatagggcgcaccaggcggttgcacttatgatacataccaacgaacttgaacaacaacaagaaaagcttacaaaagaagaagttaaagggttaaaaagttatttaaaatgttttcaaggttcaaaccttcgtagaacagaaattgcttgtatcgcatttgcaggtcaagtcctttctggatcgaccttcgcttattctccaagttattttttttcacaagctggcctaaatagtgatgacacttacaaattaaatctcggtgttactggtatagcatttactggaactttttgttcttggtttttgataaggcgttttggtcgaagaaccatctacgtcagtggatatttcatgctagttttaatgctatttcttattgggattttagcggtacccgcagaaaacaatacaaatgtcaggtgggcccaagcagcattgactatgatttgggttgccacctatgctcttacgattggacctttggccttcacaattgttagtgaaatgtctgctacaaggttgcgtgcacagtctattgcattagcaagaaatgcgtataatttggcttctttgatatcaaatgtagtagagccttatctcattactccaagtggagcgaaccttaaaggtaaaaccgcctttgtttggtttgccactgctttacctactctcatttggagttattttaggcttcctgaaactaaagatagaacgtatgaagaattagatattctttttgaaaaaggtattccttccagaaagttctcatcttatgtattcgatgctggtgccgttaacataaatattgaaagcattgaaaataaagaataa

SEQ ID NO: 284 - protein, 552 aa, Debaryomyces hansenii
MEKDKAEVLHIEEAVNDNYADKALGVTNGEIIEEAREATDNEHALTLRKAFASYKPAILWSMVFSATIIMEGYDNILMSSFFAYPSFQKKYGVDIGNGEYELLTKWQTALGTAPNVGTILGVFANGYLTERFGHRQVIMVSLIFMSAFIFIPFFAPSVEVLLVGQILCGLPWGVFATMGPTYSSEVCPMALRGYLTAYVNMCWAIGQFIAAGVLKAFVANTTEWSYRIPFAIQWAWPIPLFILTWAAPDSPWWLIRKGRVEEAERSVKRLCSKSIQHRAHQAVALMIHTNELEQQQEKLTKEEVKGLKSYLKCFQGSNLRRTEIACIAFAGQVLSGSTFAYSPSYFFSQAGLNSDDTYKLNLGVTGIAFTGTFCSWFLIRRFGRRTIYVSGYFMLVLMLFLIGILAVPAENNTNVRWAQAALTMIWVATYALTIGPLAFTIVSEMSATRLRAQSIALARNAYNLASLISNVVEPYLITPSGANLKGKTAFVWFATALPTLIWSYFRLPETKDRTYEELDILFEKGIPSRKFSSYVFDAGAVNINIESIENKE

SEQ ID NO: 285 - DNA, 1632 bp, Debaryomyces hansenii
  CDS (1)..(1632)
atggctttagaagataagttaattgggccagccttgaaattcagtacttttttggataagttccccaaagtttacaatgtttatgttattgctatgatctcatgtatttccggtatgatgtttgggattgatatttcgtcgatgtctgtgtttgttagtgataaggattatctcagcttttttaattctccaaattctgagttgcaagggtttattacttcatccatggcattaggttcattttttggagcaatatctgcttcatttgtttcagaaccctttggtagaagaccttcattaatgatatgtggtttcttttgggtcgtcggagctgtaattcaatcttcagcccaaaatgtagcccaattgataattgggcgaattatcggtgggtacggtgttggatttgggtcatcagttgcccctgtctatggttccgaaatgtcaccaagaaaaattcgtggtttgataggggggctttttcagttttccgttacactcggtattcttattatgtattttgtgtcttacggttgtcactttataaatggtgttggatccttcagaatagcttggggtgtgcaaatggttcctggacttttgatcatacttggaactttttttattccagaatcccctagatggttagcaaaacaaaatctttgggaccaggctgaaaatattgttgcagaagtgcaggcaaaaggtgatagggaagacccagatgtcataatagaagtttgcgaaattaaagaacaaatatttgcatccgagaaacttagatcttttacgtttgctgacctttttactaagaagtacatctcaagaaccatagtagcagttagtgctcagatctggcaacaattggctggtctgaatgttatgaattattacgttgtttatattttcgaaatggctggttattctggtaataacaatttaattgcatcttgcattcaatattgtttaaaagttggcgtaactggagtcgctttgttatttatggataagtttggtagacggccgctattattatttggtgctgctgggatgatggtttggcaatatgctgtagctggtctctttgccacatatgctgtacaaattgaaaaccctgacaatgatacggttagaatgagaatacctctggaccagaaggcagtaggcaaagctattatcgcatcatgctttttgtttgtttgttgttatgccgggacatggggtgttactatttgggtatattgtgctgaagtttggggcgataatgcagcaagacaaagaggtgctgctatttccactgctgctaattggatattcaatttcgcacttgctatgtatacaccatcttcttttaaaaatattacatggaaaacatacataatttatgcaacgttttgtgcatgtatgttcattcatgttttcttctttttccctgaaaccaagggcaaaagactagaagaacttggtttaatgtggcaagaaaaagttcctgcttggagaagtagactgtggcaaccagatgttccatttctttctgataaggaattacattcaaagatggaaattgaacattttgaaggagaaagaaactctgagaactcgcatgcttctcaatcgttggaaaacaaatag

SEQ ID NO: 286 - protein, 543 aa, Debaryomyces hansenii
MALEDKLIGPALKFSTFLDKFPKVYNVYVIAMISCISGMMFGIDISSMSVFVSDKDYLSFFNSPNSELQGFITSSMALGSFFGAISASFVSEPFGRRPSLMICGFFWVVGAVIQSSAQNVAQLIIGRIIGGYGVGFGSSVAPVYGSEMSPRKIRGLIGGLFQFSVTLGILIMYFVSYGCHFINGVGSFRIAWGVQMVPGLLIILGTFFIPESPRWLAKQNLWDQAENIVAEVQAKGDREDPDVIIEVCEIKEQIFASEKLRSFTFADLFTKKYISRTIVAVSAQIWQQLAGLNVMNYYVVYIFEMAGYSGNNNLIASCIQYCLKVGVTGVALLFMDKFGRRPLLLFGAAGMMVWQYAVAGLFATYAVQIENPDNDTVRMRIPLDQKAVGKAIIASCFLFVCCYAGTWGVTIWVYCAEVWGDNAARQRGAAISTAANWIFNFALAMYTPSSFKNITWKTYIIYATFCACMFIHVFFFFPETKGKRLEELGLMWQEKVPAWRSRLWQPDVPFLSDKELHSKMEIEHFEGERNSENSHASQSLENK

SEQ ID NO: 287 - DNA, 2196 bp, Debaryomyces hansenii
  CDS (1)..(2196)
atgtggccatttctagataggatcatgtatgatcactcgacggaggaggaatattacaaaaagatgcaacagaagtcgtcttcgtcgagtgccattacagtggggctagtggcggcggtagggggatttttgtatgggtacgatactgggctcattaacgatattatggagatgacgtacgtgaaggataacttcccggcgaatggacatagcttcagcgtacacgagcgagcgttgataacggccatcttgtcactcggaacattttttggggcgttgatagcgccgttgatatcggatacgtggggtagaaagttttcgatcattgtatcgtcagctctcatatttaatgtgggaaacatcttgcaggtgtcatccacagaggtggtgcttttatgtgttgggagagctgtttcggggttgtcagtgggtatactctcagccattgtgccgttgtatcaagctgaagcttcgccaaaatgggtaagaggttccattgtgtatacttaccaatgggcgataacatgggggttgttgattgctagtgctatatgtcagggggcaaaaaacattatgaattcgggctcgtatagaataccggtgggaatacagttcttgtgggcaattattttgtctgtcgggatgctttttttacccgaatctcctcgattccatgtacagaaggataatatccaagaagcattgaaatgcttagctagactaagaaaagtgccgacagatgaccctgatttgatagaagaactagttgaaatcaaggccaactatgactacgagttatcgtttggaaaggcatcctatatagattgctttaagagtggtggaggaagaaataagcaactcacgaggatgctcacaggtattggggtccaggcatttcaacaaagttcaggaatcaattttattttctattacggggttaatttcttcgcaagttcaggaattaagaattattacttaatgtcatttgtaacttatgcagttaacacactttttacaataccagggataattttgattgaagtcataggaagaaggaaactattattatttggcggcattggaatggctgtttcaaatttcataatagcaattgttggtgttagtatgtcagatgagtcaatcagttctataatatgtgtgtcattttcgtgtgtctttattgcattttttgcatcatcatggggcggtgccgtatgggcgctctcttcagatatatttggtattggtattagacaaaaagcaatatcgctaacggcagcgacaaattggttagttaattttacctttgcatttataacgccatatttgattgatactggtaaacataccgcagcattgggtaacaaaattttttttatctggggtggttgtaatgctctaggcgtcgtatttgtgtactttatggtttacgaaacgaaaggattaaaattggaagaaattgatttcatgtacaaaaactgtgtgaacgctagagcttcgactaagttcaaatctcaaaagattgtatacgccaatcaaatttcaacaccgatctcagagcttcttaatcccaaccgatcgcatattgcgattgagaaatcaagtggaagtaacaataatggcgatgatgatgagaatagcgaagaaaatcaccatgattttggtttagagaacggaaacgtcttacacaacaatttggataataggaatataactcttatcccttataagaatattatttcacctctgcgatcattcagttcagattcttcaagcgattccgactcatcttcaccactcaatgattatgaaagatacttacatagcttgcaaaaagaaggcagccatcatgacacctctcaaacttcaacgtccttaattactgacaataagctaagtcatcttaattccatgcataatgcccactcacggggtaattttactgaggaggacttgaagtacctcaatgatgaatatgatttagcgatgtcgcagaaatacccaggcacaactacggcgcctctaaaaccaagcacgaatatgactgttatagcggcgccattttttgacgctccaccaagcgattcagacacggacgacgaaagcgacgacgatgaagtcggtgacgaagatagcgaaacagaaccagaaactactaagggctcaccggttgataccaaggactctagttcgtag

SEQ ID NO: 288 - protein, 731 aa, Debaryomyces hansenii
MWPFLDRIMYDHSTEEEYYKKMQQKSSSSSAITVGLVAAVGGFLYGYDTGLINDIMEMTYVKDNFPANGHSFSVHERALITAILSLGTFFGALIAPLISDTWGRKFSIIVSSALIFNVGNILQVSSTEVVLLCVGRAVSGLSVGILSAIVPLYQAEASPKWVRGSIVYTYQWAITWGLLIASAICQGAKNIMNSGSYRIPVGIQFLWAIILSVGMLFLPESPRFHVQKDNIQEALKCLARLRKVPTDDPDLIEELVEIKANYDYELSFGKASYIDCFKSGGGRNKQLTRMLTGIGVQAFQQSSGINFIFYYGVNFFASSGIKNYYLMSFVTYAVNTLFTIPGIILIEVIGRRKLLLFGGIGMAVSNFIIAIVGVSMSDESISSIICVSFSCVFIAFFASSWGGAVWALSSDIFGIGIRQKAISLTAATNWLVNFTFAFITPYLIDTGKHTAALGNKIFFIWGGCNALGVVFVYFMVYETKGLKLEEIDFMYKNCVNARASTKFKSQKIVYANQISTPISELLNPNRSHIAIEKSSGSNNNGDDDENSEENHHDFGLENGNVLHNNLDNRNITLIPYKNIISPLRSFSSDSSSDSDSSSPLNDYERYLHSLQKEGSHHDTSQTSTSLITDNKLSHLNSMHNAHSRGNFTEEDLKYLNDEYDLAMSQKYPGTTTAPLKPSTNMTVIAAPFFDAPPSDSDTDDESDDDEVGDEDSETEPETTKGSPVDTKDSSS

SEQ ID NO: 289 - DNA, 1647 bp, Debaryomyces hansenii
  CDS (1)..(1647)
atgaccgagaaagttgatatgattggtacgacacaagacaaggtacaaactccagtaaacatggaacaagaagttataactactgcccattatactgagtatattgattcacatacttctaaatgggaaacgattaaaaagttcccctttgcatgcttttgtatcggcgtaatgatcttcaccttagttttaacatcatttgaatcgcaggcaggaggaattgttatttccatttctatgtttagaaaacacttcggtgttatacaacctgatggttcatatgttcttgaagcacaatggcaatctgctatttctggtgtgcccttggctgcgcaaattattggacagtggacaggatcttggttagctgatcattttggtaagaagtgggtcatatatgtatccatacttgtatcaacagccttcataggtatcgaatttgctgccactacaatccaaacatttttagctggaaaaacaatgaatggattatgtttgggtattatacaagcgtccattgtctcatatgtggcagatattacaccttttgctttaagaggtgcatctacagcactttgtaatatttcattctcgattggtccgttagtttgtttcattatcaactattctgagagtgataggctagattcttgggcgtatagatccatttttgctgcccaatggggattttctgctatctccttaattacactattatttgtcccagattcccctacgtattatatattaaaaggaaagaccgaaaaagcagaggcttgctatgaaaagttattaaaagatcctgtatcaattcaacaacaaatggccgttgtcataaatacgataaaagaatcacaaacatcggcagatagctgtacattcttggattgttttaaaggtaataatttgaaaagaaccatggtcgcgtccgttccatttatattctgtccattttctggtgtatattttacaggtaattatacaacatattggttccaattagcaggtttatcggattctgaatcttttaaatacactattggtgcccaacttttgtccattgctgggtgtgtggctacattgtttgttgttgatagatttggaagaagaactaatatcctttatggtgtgggaactattattgtcgtcgatttcataattggaggcacaggtttagtgaaagataatgaccaagcattaaaagctacaatatcatttatgatgatgtatgggtttttttacaactttggtctaggttctgtatgttatccaattgcctctgaaaaccctacaagtgcattaagaaccaaaactattggtcttgcactctcatcgaccaatatagcggggatggtatggtccttcgttttaccatacatatttaatccagacgaaggaaacttgggtgccagtacgatgttcattttcgccgggttttcacttctcttttgggtatacttttatttctgtgtacccgaaactgcaaataggacccttgaagaagtagatgaaatgtattttaacaaagttcccttaagaaattttgggagccacgaaactttttcttcaagagaaaatgaagaaacttttaagaatgttgctgctaatgaaaaaactaatgaaactcttcatgtcgaggaaatttaa

SEQ ID NO: 290 - protein, 548 aa, Debaryomyces hansenii
MTEKVDMIGTTQDKVQTPVNMEQEVITTAHYTEYIDSHTSKWETIKKFPFACFCIGVMIFTLVLTSFESQAGGIVISISMFRKHFGVIQPDGSYVLEAQWQSAISGVPLAAQIIGQWTGSWLADHFGKKWVIYVSILVSTAFIGIEFAATTIQTFLAGKTMNGLCLGIIQASIVSYVADITPFALRGASTALCNISFSIGPLVCFIINYSESDRLDSWAYRSIFAAQWGFSAISLITLLFVPDSPTYYILKGKTEKAEACYEKLLKDPVSIQQQMAVVINTIKESQTSADSCTFLDCFKGNNLKRTMVASVPFIFCPFSGVYFTGNYTTYWFQLAGLSDSESFKYTIGAQLLSIAGCVATLFVVDRFGRRTNILYGVGTIIVVDFIIGGTGLVKDNDQALKATISFMMMYGFFYNFGLGSVCYPIASENPTSALRTKTIGLALSSTNIAGMVWSFVLPYIFNPDEGNLGASTMFIFAGFSLLFWVYFYFCVPETANRTLEEVDEMYFNKVPLRNFGSHETFSSRENEETFKNVAANEKTNETLHVEEI

SEQ ID NO: 291 - DNA, 1659 bp, Debaryomyces hansenii
  CDS (1)..(1659)
atgtcgacagtttcaccggaaaaatctatatcgtctaagatacaacctcttgactcaaaaaatgagaagcactatgttcaagatcacatcatccaaattgaagactccaaaacctatacgtatttgggtttcaaaggtcagacattgcataacatgatttcatttctcgctggtatggggttcttacttttcggttacgaccagggtgtcatgggctcgttgttgactttgccagcttttaggaacacatttgaatctatagacacaattaaatacccagagcacgccactttccagggttttgttattgccgtttatgaaattggttgtttagcgggtgccgtttccactatgtacttgggtgatatgcttggaagaagaaaaactattctcattggatgttgtattatgattgttggtgctgtcatccagtgttcctcgttctccgttggtcagttaattgccggaagaattatcaccggtattggtaacggtatgaacacttccaccgttccaatatggcaatctgagtgtgctaagtcagaaaagagaggtaaattagttatgattcaaggtgccttaatcactggtggaatttgtatttcctactggatcgattttggcttcttcttcatcaaaaatagttctgtatcatggagattcccaattgggttccaaatatttttcccactattcatcttgcccctcatcatgtacttacctgaatctcctagatggttactaaaagccggtaaattggatgaagctgctaaagttttctctgctcttgatgacatcccagttaatgatcctactattgtctacgaagttcgagaaattgaaaactctttacaaaaggaaagacatgaaggtgaacaaaaatccaaccttcttcttttatttgctcagggtgataccaagaatttccacagaacttgcttggccgtctggtcgcaaattatgcaacaaattactggtattaatttaatcacctactatgcgggtactgtattcgaaaaatatattggtttaaatcctttgaacgcgagaatcctagccgcctgtaacggtactgaatatttcatggtttcttgggttgcattctacacgattgaaagagttggcagaagaaaattgatgttatttggggctgctggtcaagctatgtctatggctgtcttgaccggtgccacctgggctgctagtccagaacacaatgacagtggtgctgcagctattgttgctgctgtcttcttattcgttttcaacagtttcttcgctatcggttggttaggaatgacctggttatacccagctgaaattaccccattaaacatcagagctgcttctaatgggttaagtacagctgcaaattggtctttcaattttatggtagttatgatcaccccagttgctttcgaaagtattgattcctacacttatactattttcgcagtaatcaatctcttaatgattccagtcgtttatttcttctatccagaaacagctggtaggtcgttagaggaaatggataacgtcttcgaactatccaatccttacactccttgggatgttgtaaaaatcgctagagagctaccttacgagagccaaactcgtgatcgtgatattgaaaaggttaatattcagcatatcggatga

SEQ ID NO: 292 - protein, 552 aa, Debaryomyces hansenii
MSTVSPEKSISSKIQPLDSKNEKHYVQDHIIQIEDSKTYTYLGFKGQTLHNMISFLAGMGFLLFGYDQGVMGSLLTLPAFRNTFESIDTIKYPEHATFQGFVIAVYEIGCLAGAVSTMYLGDMLGRRKTILIGCCIMIVGAVIQCSSFSVGQLIAGRIITGIGNGMNTSTVPIWQSECAKSEKRGKLVMIQGALITGGICISYWIDFGFFFIKNSSVSWRFPIGFQIFFPLFILPLIMYLPESPRWLLKAGKLDEAAKVFSALDDIPVNDPTIVYEVREIENSLQKERHEGEQKSNLLLLFAQGDTKNFHRTCLAVWSQIMQQITGINLITYYAGTVFEKYIGLNPLNARILAACNGTEYFMVSWVAFYTIERVGRRKLMLFGAAGQAMSMAVLTGATWAASPEHNDSGAAAIVAAVFLFVFNSFFAIGWLGMTWLYPAEITPLNIRAASNGLSTAANWSFNFMVVMITPVAFESIDSYTYTIFAVINLLMIPVVYFFYPETAGRSLEEMDNVFELSNPYTPWDVVKIARELPYESQTRDRDIEKVNIQHIG

SEQ ID NO: 293 - DNA, 1623 bp, Yarrowia lipolytica
  CDS (1)..(1623)
atgtcgctggacaaaaaccgccagatcacgacctctgagtcgtcgtctggaagcagtgccgatgaagggacccatatcatgagaggcctgaccagtactagtactcaggacgagaccactggttccatttcggaaggcaacctagaagccgagaaaatctcgccgtttgtgtttgtgctggttgccctggcctccatttccggattcctgtttggatacgacacgggctatgtttctggagctctggtggtcatcaaggaggatcttggacgtgccctttccaacggagataaggagctgattactgcttccacgtccctgggagctctccttggaggagttattgccggagccatgtgcgacttctttggccgaaagtgggttatcacctttgccaatattctgtttctggttggagctgccattcagtgtggagctcacgccgtgtggaccatgatcggaggccgattcgtcatgggatggggcgtgggtattgcatctctatgtgctcctctgtacatttccgagctggcccccactcgaatccgaggtcgtcttgtcgttctcaacgtcctggctatcaccggaggacagcttgtggcctacggaattggtgctggcatggcccacgtgcaccaaggatggagaattctagttggtctgtctatggtgcctgcctttgtgcaaatggtcatctttgtgttcatgcccgagactcctcgatatcttgttcgaaagaataagattgctgaggccaagaaggtgctggccaagacatatgccaccgatgacgacaaccttctcgaccgaaagctccacgaactcatgctccacaacgcatacaaggagtccggcctgtccactatggcgcgagctcgaaacactatgaaggaactttattgcgtacccagcaacttgcgagccctcataattgcttgtggactgcagggaatccagcagttttgtggtttcaactcgctcatgtacttttctgctaccatttttgaggtggtgggctttgataacgccacagccgtctccatcatcgttgctggaacgaactttgtcttcaccattgtcgcctttatggtcattgaccgtattggacgacgccgaattctcctgggaaccatctggggcatgtctctgggactcgttgtcaacgccattgctttccacttccttgacaagcagaaggaaaagaaccccaaccatgagctcgataaggaacacatttccggatgggcatacgtggtcctcgttgctcagctcgtctacgtcgccttctacgccactggtatcggtaatgtgccatggcagcagtcggagctgttccccatctccgtccgaggtgttggaactggcatggccactgccaccaactgggcaggatcgctcattgtgtcctccactttcctgaccatgttggaaaatatcacccccactggaacattttccttctacgccggtctctgtgctctcggagaagtgtttgtcttcttcctgtatcccgagacttccggcatggatctggagcagattcaacagctgctgacgggaggtttcaacatcaaggagagtatgcggctgtctgatgaggccaagagaggctacaagaagtag

SEQ ID NO: 294 - protein, 540 aa, Yarrowia lipolytica
MSLDKNRQITTSESSSGSSADEGTHIMRGLTSTSTQDETTGSISEGNLEAEKISPFVFVLVALASISGFLFGYDTGYVSGALVVIKEDLGRALSNGDKELITASTSLGALLGGVIAGAMCDFFGRKWVITFANILFLVGAAIQCGAHAVWTMIGGRFVMGWGVGIASLCAPLYISELAPTRIRGRLVVLNVLAITGGQLVAYGIGAGMAHVHQGWRILVGLSMVPAFVQMVIFVFMPETPRYLVRKNKIAEAKKVLAKTYATDDDNLLDRKLHELMLHNAYKESGLSTMARARNTMKELYCVPSNLRALIIACGLQGIQQFCGFNSLMYFSATIFEVVGFDNATAVSIIVAGTNFVFTIVAFMVIDRIGRRRILLGTIWGMSLGLVVNAIAFHFLDKQKEKNPNHELDKEHISGWAYVVLVAQLVYVAFYATGIGNVPWQQSELFPISVRGVGTGMATATNWAGSLIVSSTFLTMLENITPTGTFSFYAGLCALGEVFVFFLYPETSGMDLEQIQQLLTGGFNIKESMRLSDEAKRGYKK

SEQ ID NO: 295 - DNA, 1602 bp, Yarrowia lipolytica
  CDS (1)..(1602)
atgtccactagtgctatgaccgacgattatcccatggctgaggtctccattactgaggagaccaagatgcctgagcctgccaagaaatcgcagcttcttgtcattctgctctgtctctttgccgccatgggcggttttgtctttggctatgacactggtaccatttctggcttcatcaacatggaccctttcctagagagctttggagaagccgatgagtctggcgttttctttctatcccgaatccgagctgggctcattgttggactcttttccattggtgctttccttggcacccttcttggtggcttccttgctgacaaggttggtcgaaagaagggaattgtctatgtcgccatggtctacattgttggtatgcttatccagatcacagccttcacagcctggtaccagattgccattggtcgtgtcatcggtggtgttggtattggtgcactctctgtgctggtccccatgttccagtcagagactgctccccagaatcttcgaggcgctcttgtctcttctttccagctgtttattactctcggcatcttcattggatttagtgtttgctacgctaccaagtcgcggctcgataccggtgcctaccgaatccccatgggtctttgcttcgcctgggcttttatccttctcattggcatgtgcttcatgccagagtcccctcgattcctggtttcaattggccgcattgaggaggcccgaaaggctatggccatgacaaaccaggttcctctccacgacgctgtcattgatgaggaactcaaggctattgagaactctgtcattagggaaaagagtgctggtaaggccacatggaaagaacttttcactggcgagccccgaatgggctaccggcttacccttggtattctcgtccaggttctccagcagctctgtggtgccaactactttttctattacggaacttctatcttcaaggccattggaatgtcggattctttcgctacttcgatgatctttggcggaatcaacctcctgtctacctttggaggtctctacattgttgatcgattcggtcgacgaaagtgccttcttggtggagccatggtcatgtttgtctgtttcctcgtctattctactgtcgggttcgctgctctttatcccaacggtgataccacccttcccgccagaaaggctgttggtgatgtcatgattctgttcacctgtatcttcatcgccgctttcgcctctacgtgggcccctattgccttcgtcgttgtttctgagaccttccctctcagaatgcgatcaaagggaatggctgttgctactggaggaaactggatgatcaacttcctcgtttctttcctgactcccttcatcaccagttccattgggttcaagtacggttatgtcttcactgcttgcattggtttcgccattatctttgtcttcttcttcatccctgagaccaagggtctgtcccttgaggatgttgacgagctgtacgcttcaggtgtcagtgctcgaaactcccccaactgggttccttcttccaagaagcaggaagtcaacgaacctaagaacagtatgaccgacttctccgagtcctcttag

SEQ ID NO: 296 - protein, 533 aa, Yarrowia lipolytica
MSTSAMTDDYPMAEVSITEETKMPEPAKKSQLLVILLCLFAAMGGFVFGYDTGTISGFINMDPFLESFGEADESGVFFLSRIRAGLIVGLFSIGAFLGTLLGGFLADKVGRKKGIVYVAMVYIVGMLIQITAFTAWYQIAIGRVIGGVGIGALSVLVPMFQSETAPQNLRGALVSSFQLFITLGIFIGFSVCYATKSRLDTGAYRIPMGLCFAWAFILLIGMCFMPESPRFLVSIGRIEEARKAMAMTNQVPLHDAVIDEELKAIENSVIREKSAGKATWKELFTGEPRMGYRLTLGILVQVLQQLCGANYFFYYGTSIFKAIGMSDSFATSMIFGGINLLSTFGGLYIVDRFGRRKCLLGGAMVMFVCFLVYSTVGFAALYPNGDTTLPARKAVGDVMILFTCIFIAAFASTWAPIAFVVVSETFPLRMRSKGMAVATGGNWMINFLVSFLTPFITSSIGFKYGYVFTACIGFAIIFVFFFIPETKGLSLEDVDELYASGVSARNSPNWVPSSKKQEVNEPKNSMTDFSESS

SEQ ID NO: 297 - DNA, 1701 bp, Yarrowia lipolytica
  CDS (1)..(1701)
atgtccgggcagacatatatagagggatggcctggagttgagccagtcctttttcttctttctctatcgactctgtcactctctcctccagccatgttttggatttcaatgaaaaacgagcccaagcaggtgctcaacagaaccctgtggttcgccatcttcgtctttggtcttctgggaacctcccgaggtctcgacgagggaaacatttccggtaccgttgcccagccatctttcatctccaaattcaagctccatgaccccagtctatccaaggacgcccaggctaacttgctgtccaacatcaccagtatggtccagattggctctgttgccggagctcttatcgctatgctcattgtcgatcgtatcggccgactgtgggctctcagagaaatgcttgtcatctggattgtcggtgtcatcgtccagattacctccaacaatgtcggtcaactgtacgctggtcgttttgttgccggcatgggtatcggtcagtctgttgtcattggtcccacctacctggctgagattgctcctcctcatgtcagaggtctggcaacctgtgtcttctctggttccgtctatctgggagtcatgctgtcgtactttgccaactatggtaccactctgcacatctcaaacacctcccggaaccagtgggtcatccccaccactctgcagatcatcttctctggtatcatgctgattggctctatctttgtccacgagtctcctcgatggctcatgaagatcggcaaggaagaagaggccgttgaaactctgtgcaagatccgtaagcttcccgccgacgatctctacgtccagggcgagattctcatggtgcgagagcagattgagcgagaaaagcaggctatgaccggcgcctcatactggtcgctgttcaaggagctgctggctacccctgccaaccggtaccgactcttccttggtctcatgatccagattctgggccagtggtccggagccaatgccattaccatctatgctccttccttcttccagatgatcggtgtcagcggccagcagcagaagatgttcgccacggccattcttggagtcgtcaagttcgccgcctccattatttgcgccgtcttcctaatcgataccattggcagacgacgatctctctactcgggtatcactctgcagttcatctccattctgtatgtggccatctacctggctgtggtgcccaacaacgacccctcgcggatcaagtctgctgccgagcgacatgccggagtcggcgccattgccttcatctacctctcgggtgtgggctgggctctcggttggaactccatccagtacctcatcaacgccgagatctacactgttcggcacagatctctggcgtccggtctcatcatgacggtccatttcgccaaccagtacggcaactccaaggctctgccttccatgcgactgggaatgaccgacactggagccatgttcttcttctccgggatcattctcgtcggtctggtgtggtcctggttcttcctgcccgaggtctcgggccggtctctcgagtccatcgacgaaatgttctcgctgccttggtatctcattggaagacggggccaccagatggtgcccgagacttcagctgctgtgcagattgccgccgacgaggatgagaagaagggcggggtggtccatgtggagaactgctag

SEQ ID NO: 298 - protein, 566 aa, Yarrowia lipolytica
MSGQTYIEGWPGVEPVLFLLSLSTLSLSPPAMFWISMKNEPKQVLNRTLWFAIFVFGLLGTSRGLDEGNISGTVAQPSFISKFKLHDPSLSKDAQANLLSNITSMVQIGSVAGALIAMLIVDRIGRLWALREMLVIWIVGVIVQITSNNVGQLYAGRFVAGMGIGQSVVIGPTYLAEIAPPHVRGLATCVFSGSVYLGVMLSYFANYGTTLHISNTSRNQWVIPTTLQIIFSGIMLIGSIFVHESPRWLMKIGKEEEAVETLCKIRKLPADDLYVQGEILMVREQIEREKQAMTGASYWSLFKELLATPANRYRLFLGLMIQILGQWSGANAITIYAPSFFQMIGVSGQQQKMFATAILGVVKFAASIICAVFLIDTIGRRRSLYSGITLQFISILYVAIYLAVVPNNDPSRIKSAAERHAGVGAIAFIYLSGVGWALGWNSIQYLINAEIYTVRHRSLASGLIMTVHFANQYGNSKALPSMRLGMTDTGAMFFFSGIILVGLVWSWFFLPEVSGRSLESIDEMFSLPWYLIGRRGHQMVPETSAAVQIAADEDEKKGGVVHVENC

SEQ ID NO: 299 - DNA, 1779 bp, Yarrowia lipolytica
  CDS (1)..(1779)
atgggacgaaactggctagcgttttcacaagcctccactgaggtcaagaccgagtttctgggtcttcgaggccagaagctccaccgagccgtggccttcattgccggtatgggtttcctgctgttcggatacgaccagggagtcatgggtggtctgctgaccctcccccggttcatccaccagttccccaagatggacacctccgactacgttcctgaggagacccgaaagttcaacaccaccatccagggtgtgtctgtcggtatttacgagattggatgtatgatcggcgctctgttcaccatgtgggccggagacaaactcggtcgacgacgtatgattttctggggctctatcatcatgactattggtgccattctgcagtgtgcttcttactctcttggtcagttcattaccggtcgagttgtttctggtgttggtaacggttttatcaccgccactgttcccatgttccagtccgagtgtgccaagcctgagcgacgaggagctctcgtcatgatggagggtgcccttatcaccggtggtattgccctctcttactggatcgattttggcttctactgggtcaacaacgatgccgactggcgattccctattgctttccagatcatcttctccatgttcctcaccttcaccgtcatgtctcttcccgaatctccccgatggcttgtcaagaagcaacgattcgacgaggctgctggtgtcttctctgctctcgaggatgtgcctattgatgacccttacgtgattgaccagatcgccgaggtcaaggagtccatcatgatggagcagcttgcccagcttggtgttgacggatccgaggctcgagagaagattgcctctggagagttccagatgggtgctgagctgcccttcttggaacagatgaagctgctcttcacctttggcaagaagaagaacttccaccgaaccatgctggcctactggaaccaggtcatgcagcagattaccggtatcaacctgattacctactacgccgcctacatttacgagacatctgttggtatgaacgccaccaactcgcgaattctcgctgcctgtaacggtactgagtacttcctcgcctcctgggttgccttctacaccattgagcgattcggaagacgaaagctcatgttgttcggagccattggtcaggcttgcaccatggctattcttactggaactgtctacgccgcttctcctcccgaggacggtggacttgacaactctggcgctggtattgcagctgccgtcttcctcttcgtctttaacaccttcttcgccattggctggctcggaatgacctggctgtaccctgccgagatcacctctctggagatccgagcccccgccaacggtctgtccacctccggtaactgggtcttcaacttcatggtcgtcatgatcacccccgttgccttcgatacaatcaagtggaagacttacatcattttcgcctgcatcaacgccgccatggtccccgtggtctacttcttctaccccgagaccgctggacgatctctcgaggagattgacaagatcttcgccgagtccaacccccgaactccctgggatgttgttggcattgcccgacgaatgccccgagagtctgctcttacccgacgaaagcagggtgtcaaccagaccttcgacaactccaacgagaaggctgtggtcgaggagaacaccgagtccgctgttggctccaccaccggctctgcctctccttcttttgagaacgtttctcaagcttaa

SEQ ID NO: 300 - protein, 592 aa, Yarrowia lipolytica
MGRNWLAFSQASTEVKTEFLGLRGQKLHRAVAFIAGMGFLLFGYDQGVMGGLLTLPRFIHQFPKMDTSDYVPEETRKFNTTIQGVSVGIYEIGCMIGALFTMWAGDKLGRRRMIFWGSIIMTIGAILQCASYSLGQFITGRVVSGVGNGFITATVPMFQSECAKPERRGALVMMEGALITGGIALSYWIDFGFYWVNNDADWRFPIAFQIIFSMFLTFTVMSLPESPRWLVKKQRFDEAAGVFSALEDVPIDDPYVIDQIAEVKESIMMEQLAQLGVDGSEAREKIASGEFQMGAELPFLEQMKLLFTFGKKKNFHRTMLAYWNQVMQQITGINLITYYAAYIYETSVGMNATNSRILAACNGTEYFLASWVAFYTIERFGRRKLMLFGAIGQACTMAILTGTVYAASPPEDGGLDNSGAGIAAAVFLFVFNTFFAIGWLGMTWLYPAEITSLEIRAPANGLSTSGNWVFNFMVVMITPVAFDTIKWKTYIIFACINAAMVPVVYFFYPETAGRSLEEIDKIFAESNPRTPWDVVGIARRMPRESALTRRKQGVNQTFDNSNEKAVVEENTESAVGSTTGSASPSFENVSQA

SEQ ID NO: 301 - DNA, 1620 bp, Yarrowia lipolytica
  CDS (1)..(1620)
atgttctggaaaaacatgaagaatgagcctaaacaggtcctcaattggactctgtggctctcagtcctagtctttggcctgcttggttcagcccgaggccttgatgaaggaaacatctcaggtacatcccaccaggtctccttcgagaaccaattcgggctcagagaccccaacaagaccgaaaaagaaatcgcagatgccctctccaacatcactgccatggtccaactgggctctgtgggaggttccattatcgccatgttcgcccaagacaagattggacgagtccgatgtttgcaacagatgctaattgtgtggatcgtcggtgttgttatccaagtcacctctcacggccaaggtcaactcctggctggtcgattcattgctggtctaggaatcggtcagtccgtcgttattggtcccacatatcttgctgaggtgtctcccaagaatgttcgaggtctctgcacatgtgtcttttcgggctcagtctatctgggtatcatgttggaatactttgccaactattccacaacactgaacgtctctgacgagagcagaatgcagtgggtactccctaccagtgtccagttcatctttgctggtctccttttcattggatcattcttcatttacgagtctccaagatggctcatgaagattggccaggaggaaaaggcaatggaaactctgtccaagatcagacatcttcccattgacgacgtttacatccaaggagagatccttgatgtccgagaacaggtcgagcgagaaaagcaggccctatctggtactagcatcttttctattttgaaggaacttgttgctactcaggccaatcgatacagacttttcattggcatcatggtccaactacttggccagtggtcaggagccaacgcagtcaccatctactcgccccagttctttgccatgctcggtgtcactctccgaactgatcgaatgatgtacactgccattctaggtattatcaagtttgctgcttccgttgtctgtgctgtcttcctcattgataccatcggccgacgacgatctctctacaccggcgtctgtctccagttcatctccatgctgtatcttggtatctatctgtctattgttcctgctagctctggggctgttgaggacagaactgcttcccagagacatgctggaggaggtgccatcgctgccatctacctgtcaggttgcgggtgggctctcggctggaactccatccagtacctcatcaacgctgaaatctacactgttcgacaccgatcacttgcctgcggtatcatcatggtattccactttgtcaaccagtatggtaactccaaggcactcccctacatgcgaaagtctctgactgaccatggaaccatgttcttcttctctggtgtgattctcatcggtctggcctggtcatggttcttccttcccgaggtctccggaagatctctggaatctatcgacgagatgttctctctaccttggtatctcattggacgacgaggagccaagcttgtgcccgaaacaagcaccactacccagctgcaggaagacgacgatctggccaaggagaagaagggagccactgttcacgtggagacctgttag

SEQ ID NO: 302 - protein, 539 aa, Yarrowia lipolytica
MFWKNMKNEPKQVLNWTLWLSVLVFGLLGSARGLDEGNISGTSHQVSFENQFGLRDPNKTEKEIADALSNITAMVQLGSVGGSIIAMFAQDKIGRVRCLQQMLIVWIVGVVIQVTSHGQGQLLAGRFIAGLGIGQSVVIGPTYLAEVSPKNVRGLCTCVFSGSVYLGIMLEYFANYSTTLNVSDESRMQWVLPTSVQFIFAGLLFIGSFFIYESPRWLMKIGQEEKAMETLSKIRHLPIDDVYIQGEILDVREQVEREKQALSGTSIFSILKELVATQANRYRLFIGIMVQLLGQWSGANAVTIYSPQFFAMLGVTLRTDRMMYTAILGIIKFAASVVCAVFLIDTIGRRRSLYTGVCLQFISMLYLGIYLSIVPASSGAVEDRTASQRHAGGGAIAAIYLSGCGWALGWNSIQYLINAEIYTVRHRSLACGIIMVFHFVNQYGNSKALPYMRKSLTDHGTMFFFSGVILIGLAWSWFFLPEVSGRSLESIDEMFSLPWYLIGRRGAKLVPETSTTTQLQEDDDLAKEKKGATVHVETC

SEQ ID NO: 303 - DNA, 1737 bp, Yarrowia lipolytica
  CDS (1)..(1737)
atgaagctacaagtacccgcgtttgcgcggtcgtcttctgacgtgaaaacgtcattcatgggagcccggggccagaaactgcacaatctcgtggcagcaattgcaggattgggattcttgctgtttggatacgaccagggagttatgggcggtcttctaactctcgacacgttcatccaacagtttcccaaaatggacacctccgactacctgcctccaaaggtcaagaccttcaacaccaccattcaaggcacagccgtgggcatctacgaaatcggatgcatgattggagctctgttcaccatgtgggctggagacaagcttggaagacgctacatgatcttctttggctccatcatcatgacgattggagcgattctgcaatgtgcttcctactctctgggacagttcattgccggaagagtcatttctggaattggaaacggcttcatcacagccacagtccccatgctccagtcggaatgcgccaaacccgaacgtcgaggaaagttggtcatgctggagggagctctcatcaccgctggaattgctctttcgtattggatcgactttggcttctattgggtgcggaccaacgacgccgactggcgtttccctatcgccttccagattgtcttctctctggttctcaccttcaccatcatgtctcttcccgagtctccccgatggctcgtgaagaaacagagattcgaagaagcggcaggagtttttgctgctctcgaggatgtgcctctggacgacccctacgtgattaaccagatcacctccgtcaaagaatcgatcatgatggagcagctggcccagttgggtgtcgatggtgtcgatgctcggcggaaaatccagtcgggcgagttccaaatgggccaggagctgtctttcatcggtcaaatgaaactcatgttcacctttggcaaaaagaaaaacttccaccgaacaatgctggcctactggaaccaggtgatgcagcaggtgaccggcatcaacctcatcacctactacgcagcttacatttaccaaaccagcgtgggaatgaatgccacagactcgcgaattctggccgcctgcaacggaacagagtactttatggcttcctgggtcgccttctacacaattgagcgatttggacgccgaaaactcatgctgtttggagccgtaggccaagcatgcactatggccattctcaccggatgtgtttacgcagcttcaaagcccgaagatggaggcttggacatgcagggggcgggaatcgctgcggccgtctttctgtttgtgttcaacactttcttcgccattggctggctcggtatgacctggctctaccctgcggaaatctcgtctttggagatcagagctccggcaaacggtctttccacctcgggcaactgggccttcaacttcatggtggtaatgatcacccccgtggctttcaactccatcaagtggaagacgtatatcatttttgcctgcatcaacgccttcatggtccccatggtgtactttttctaccccgagaccgccggacgaagcttggaagagattgatatgatctttgccgagtccaaccctcgaactccctgggacgtggttggtattgccaaccgtctgcccaagaactccgtggcaacttatgatgactacgaggctggtgaacaggaggagaaggccattgttgagacagcggaaagtgtctctcatgattcggccgagtttcagtga

SEQ ID NO: 304 - protein, 578 aa, Yarrowia lipolytica
MKLQVPAFARSSSDVKTSFMGARGQKLHNLVAAIAGLGFLLFGYDQGVMGGLLTLDTFIQQFPKMDTSDYLPPKVKTFNTTIQGTAVGIYEIGCMIGALFTMWAGDKLGRRYMIFFGSIIMTIGAILQCASYSLGQFIAGRVISGIGNGFITATVPMLQSECAKPERRGKLVMLEGALITAGIALSYWIDFGFYWVRTNDADWRFPIAFQIVFSLVLTFTIMSLPESPRWLVKKQRFEEAAGVFAALEDVPLDDPYVINQITSVKESIMMEQLAQLGVDGVDARRKIQSGEFQMGQELSFIGQMKLMFTFGKKKNFHRTMLAYWNQVMQQVTGINLITYYAAYIYQTSVGMNATDSRILAACNGTEYFMASWVAFYTIERFGRRKLMLFGAVGQACTMAILTGCVYAASKPEDGGLDMQGAGIAAAVFLFVFNTFFAIGWLGMTWLYPAEISSLEIRAPANGLSTSGNWAFNFMVVMITPVAFNSIKWKTYIIFACINAFMVPMVYFFYPETAGRSLEEIDMIFAESNPRTPWDVVGIANRLPKNSVATYDDYEAGEQEEKAIVETAESVSHDSAEFQ

SEQ ID NO: 305 - DNA, 1548 bp, Yarrowia lipolytica
  CDS (1)..(1548)
atgggactcgctaacatcatcaaccgtggagaaaagcccgagggctcggccttcatggcggcctttgtggccgtgtttgtcgcgtttggaggtattctgtttggatacgacactggaaccatttccggcgtcatggccatgccattcgtcaagaagacctttacagatgacggcctggagttcacttctgagcagacctcgctcatcacttccattctttctgcaggcaccttcactggagccatttctgctccctgggcctctgatactctgggaagacgactgggtctgatcctcttctgtgtcgtcttctctgttggcgctattcttcagactgctgccaccggccgaacgcttttgattgtcggacgagttgttgctggtcttggtgttggtggagtctcttccatcgttcctctttaccagtctgaggttgcccccaagtggatccgaggtgccgttgtctccatctaccagtttgccatcaccattggtcttctgctggctgccattgtcaacaacgcaaccaaaaacaaagacaacagtgcttcctaccgaattcctctcggccttcagcttctgtgggccgtcatcctgagtggaggtctcatcctgctaccggagactcctcgattctggatcaagaagggcgagtacgacaaggccgccgattccctgcgacgactacgacgacttcctgttgagcacgaggctgtacagaaggagctcctggagatccaatcttctcacgaccacgagatgcagatcggtagcgccacctgggccgcctgcttctcccccaaggggtcccagctgaagcgaatgctgaccggtattgccattcaggccctgcagcagctcaccggtatcaacttcatcttctactacggaaccgagttcttcaagaagtccaacatctccaaccccttcctcatccagatgatcaccaacattgtcaacgtggttatgaccatccccggtatcatgtttgttgatcgagtcggacgacgaaagctgctgttgatcggagctatcgtcatgtgctcttccgagtttatcgtggcggctgttggtactgccattgataacgagacctcctcaaaggttctgattgccttcacttgtaccttcattgccggtttcgccgccacctggggtcctattgcctgggttgtcattggagagattttccctctacgaatccgagccaagggtgttgctctatgcgccgcctccaactggcttttcaactttgccattgcctttgcaaccccctacctcgtcgacgaggcccctggatcggccggtctcaagaccaaggtcttcttcatctggggaggctgcaacttcctgtgcatcgccttcacttacttcttcatctacgagaccaagggtcttactctggaggaggtggaccagatgtacgccgagatcaagattgcttctcgatcccaccagtttgtgcctaccactcgagtcgctgcttacgacgagcacgcttctgacgacaagaaggacggacagcacgtctacattgagtctgtctag

SEQ ID NO: 306 - protein, 515 aa, Yarrowia lipolytica
MGLANIINRGEKPEGSAFMAAFVAVFVAFGGILFGYDTGTISGVMAMPFVKKTFTDDGLEFTSEQTSLITSILSAGTFTGAISAPWASDTLGRRLGLILFCVVFSVGAILQTAATGRTLLIVGRVVAGLGVGGVSSIVPLYQSEVAPKWIRGAVVSIYQFAITIGLLLAAIVNNATKNKDNSASYRIPLGLQLLWAVILSGGLILLPETPRFWIKKGEYDKAADSLRRLRRLPVEHEAVQKELLEIQSSHDHEMQIGSATWAACFSPKGSQLKRMLTGIAIQALQQLTGINFIFYYGTEFFKKSNISNPFLIQMITNIVNVVMTIPGIMFVDRVGRRKLLLIGAIVMCSSEFIVAAVGTAIDNETSSKVLIAFTCTFIAGFAATWGPIAWVVIGEIFPLRIRAKGVALCAASNWLFNFAIAFATPYLVDEAPGSAGLKTKVFFIWGGCNFLCIAFTYFFIYETKGLTLEEVDQMYAEIKIASRSHQFVPTTRVAAYDEHASDDKKDGQHVYIESV

SEQ ID NO: 307 - DNA, 1698 bp, Yarrowia lipolytica
  CDS (1)..(1698)
atgggcttcagaggccaaagactccatcactatgttgcgactgtcgcaggcatgggttttctactctttggatacgaccagggagtcatgggaggtcttcttactcttccctcctttgtcaagcagttccccaagatggacacttctgactatctaccgccggatgtcaagtccttcaacaccaccatccaaggcacagcaattgccatctacgagatcgggtgcatgatgggggctctattcaccatgtggggaggagacaaggtcggtagacggtacatcatcttctacggatcaatcatcatgaccattggagccgttctacaatgtgcctcatactctttgggcatgttcattacaggccgtgtcgtctcgggtgtcggtaacggattcatcaccgcaacagtccccatgctccagtctgagtgtgcgaaaccagagaaacgaggcaaactcgtcatgttggaaggagctcttatcaccgccggtatcgctctttcatactggatcgatttcggcttctattgggtcaaggccaacgacgctgactggcggttccctgtcgcattccaaattgtcttctgtctctttctcttcttcaccgttcttactatccccgaatctccaaggtggttggtcaaaaaggggcgattcgaagaagcagccggagtctttgctgccctcgaagatgtggacattgaagacccctacgttgtcacccagatcacatacgtcaaagaatccatcatgctggaacaattggctcagttgggtattgatggacctgctgctcgtgagaagattgcagcaggcgagttttcaatgggtgaggaactgcccttcctgtcccagatgaaactcatgttcacctttggcaagaagaagaatttccaccgaaccatgctggcctactggagtcaggtcatgcaacaaatcacaggtatcaatctcatcacatactatgcggcgtacatctatgagacgtctgtcggcatgacccctactaattctcgaattctcgctgcttgtaacggtaccgaatacttcctagcctcttggatcgccttctacaccatcgagcggttcggacgtcgaaaactcatgattttcggagctgctggtcaggcagctactatggctattctcacaggatgtgtctacgctgcatcttcaccggcagacggaggactcgacaatcagagcgccggtgttgctgctgccgtcttccttttcgtcttcaacaccttctttgccattggttggctgggcatgtcgtggctgtatcctgccgagatcagttccttggagattcgagctcccgccaacggcctttccacctctggaaactgggtcttcaacttcatggtcgtcatgatcacccccgtggccttcgacactatcaagtggaagacctacatcatctttgccgtcatcaacgcagccatggttccagtcgtctacttcttctatcccgagactgccggtcggtctctggaagagattgaccagatctttgccgactccaaccccaagacaccctgggacgttgtctggatcgccagacggctccctaagagcactgctgtcgaccacaacctcgttgagcctcgaatcttgctcgaagagaagactgcccttgagacggtcgagtctgtttcccccactccttctgatcaagaggaaaccagacatgtttaa

SEQ ID NO: 308 - protein, 565 aa, Yarrowia lipolytica
MGFRGQRLHHYVATVAGMGFLLFGYDQGVMGGLLTLPSFVKQFPKMDTSDYLPPDVKSFNTTIQGTAIAIYEIGCMMGALFTMWGGDKVGRRYIIFYGSIIMTIGAVLQCASYSLGMFITGRVVSGVGNGFITATVPMLQSECAKPEKRGKLVMLEGALITAGIALSYWIDFGFYWVKANDADWRFPVAFQIVFCLFLFFTVLTIPESPRWLVKKGRFEEAAGVFAALEDVDIEDPYVVTQITYVKESIMLEQLAQLGIDGPAAREKIAAGEFSMGEELPFLSQMKLMFTFGKKKNFHRTMLAYWSQVMQQITGINLITYYAAYIYETSVGMTPTNSRILAACNGTEYFLASWIAFYTIERFGRRKLMIFGAAGQAATMAILTGCVYAASSPADGGLDNQSAGVAAAVFLFVFNTFFAIGWLGMSWLYPAEISSLEIRAPANGLSTSGNWVFNFMVVMITPVAFDTIKWKTYIIFAVINAAMVPVVYFFYPETAGRSLEEIDQIFADSNPKTPWDVVWIARRLPKSTAVDHNLVEPRILLEEKTALETVESVSPTPSDQEETRHV

SEQ ID NO: 309 - DNA, 1665 bp, Yarrowia lipolytica
  CDS (1)..(1665)
atgtacaaggtccataacccctacctcacggcggcggtagccaccatgggcggaatgctctttggtttcgatatctcgtccgtgtcggcctttgtgggcgaagataactacatgaactactttggtcatcccacctccttccagcagggaggtatcaccgcctccatggccggaggatccatgctgtcgtgtgcgtttgccggctacatttccgaccgggttggccgaaagcccaccattcaatttgccgccgcctggtggatggttggcgcctccattcaatgctctgcccagaatatgggccaactgattgccggccgggccatttccgggcttggaatcggcctcggctcgtcccagatccccgtcttcatctccgagttgtcccccaagaagatccgaggccggctcgtcggctgcttccaatggtccgttacctggggtattctcatcatgttctacatttcgttcggctgctcatacatcaagggccactcgtccttccgactggcgtggggcatccagctgattccaggagccatgttggcgttcggaatgatgctgctggacgaatcgccgcgatggctggcgtccaaagaccgctgggaagaggccatccagatcatccgctccatcaatgccaactacggatccgaggaggacattctcatggaaatcgaagatctgcgagaggtggtgcgaatcgaccacgagtccaagtcggtcaccatctgggacctgttccgaaaagactccatcaaccgaaccatggtcggagtgtgggcccagatctggcaacaactgactggaatgaacatcatgatgtactacgtggtcatcatcttcaaaatggccggctactcgggcaaaagtgccgtcattgtctccggctccatccagtacatcatcaacgtggtcatgaccatcccggcgctgcttttcattgataaaatcggacgaagacccctgctcctctgtggaagcatgctcatggccacctggctgctagctgtcggaggaatgctaggagcctacggaatccaaatgccccaaggtctaccggcagtaccctccaaaaaccaggcagcggacccctacaccaccatctacattcccgacaaccaggcgccggcccgaaaggccattatcgcctgttgctatctgtttgtcgcctcttttgcacccacctggggccccggcatctggctctactgctccgagatcttccccaacaaacaacgagcgctggccaactcgctgaccgccggcgccaactggggcttcaactttgccctggccctgtttgtgcccaccgccttcaagaacatcaactggaaggtgtacatcatcttcggtgtcttctgcatcgtcatgtccatccacgtcttcctgctcttccccgaaaccaagggcaagagtctggaggtgattgaccagatgtgggacgcccgcgtgcccgcttggaaaaccgcctcctgggtccccgaccacatgccttctcattacgcaggggaccaggaggaaaagcccaccgacgaactggccgaggcgccgtttcacgaggagaatgccccggtgaacaccgagacccctcctcatgaggatgagcccacttttgcggagaccgagcccaagacccagtatcctggaactgagcatgtctaa

SEQ ID NO: 310 - protein, 554 aa, Yarrowia lipolytica
MYKVHNPYLTAAVATMGGMLFGFDISSVSAFVGEDNYMNYFGHPTSFQQGGITASMAGGSMLSCAFAGYISDRVGRKPTIQFAAAWWMVGASIQCSAQNMGQLIAGRAISGLGIGLGSSQIPVFISELSPKKIRGRLVGCFQWSVTWGILIMFYISFGCSYIKGHSSFRLAWGIQLIPGAMLAFGMMLLDESPRWLASKDRWEEAIQIIRSINANYGSEEDILMEIEDLREVVRIDHESKSVTIWDLFRKDSINRTMVGVWAQIWQQLTGMNIMMYYVVIIFKMAGYSGKSAVIVSGSIQYIINVVMTIPALLFIDKIGRRPLLLCGSMLMATWLLAVGGMLGAYGIQMPQGLPAVPSKNQAADPYTTIYIPDNQAPARKAIIACCYLFVASFAPTWGPGIWLYCSEIFPNKQRALANSLTAGANWGFNFALALFVPTAFKNINWKVYIIFGVFCIVMSIHVFLLFPETKGKSLEVIDQMWDARVPAWKTASWVPDHMPSHYAGDQEEKPTDELAEAPFHEENAPVNTETPPHEDEPTFAETEPKTQYPGTEHV

SEQ ID NO: 311 - DNA, 1740 bp, Yarrowia lipolytica
  CDS (1)..(1740)
atgtcgcaccggccctgggattgcctaccgctatggaacaccgtggtcgttttccgaagatgtgtgctttggagcctggtcatgtgttttgtaattgtgatggacggctatgacggttttctgattccgtccttctacgcggtgccgtcattccagcgcagatacggagtacagctgccggacgggtcgtggacggtcgaggccaagtggcagacggcctacatggttggagcaccgatagggcggatagctggggctttgggggttggggttttggccgaccggttcgggaggaagcgggttactctggtgggtcttttttgcctgtcggggatcaccttcattgtcttttttgcggtcggcaaggccatgttggtggtgggctggtttttgtcgggattgatctggggaatcttcaacaccatgacgccgacctacgtgtctgaaatctgtccggtttcgcttcggagcacgtttgcagcggccattaatctctcctgggtcgtcggacaattcatttccaccgctgtgatcaccgcctcggagtcccgacaggacgaatgggcttatagagtacctctggcggtccaatgggtgtttcccgtggtgctgattccgcttgttatggtcatgcccgagtctccctggtggattttgaagcacggggacaaaaagggcgccagacaagttctgaccagactcatggacgaaaaagacgtcgatatagacatgtatttggagtacatgcgtcagacgctggaggatgaagttgatggaggctcgttcgtcgactgcttcaaggggtcagatgttcgtcggacggagatttgctgtctcacatacttcttccaaccgctctcgggactctacattctgtcctatgccgcctactttttgcagctcacgggaatcccgcaaaatgtcgttttcaagctgactctggggctgactggactagcggtgatggcgtccttggttgcacctatcgtgattctcacctttacccgacgctccatttatatgggctctttagctctcatggctgccactcttttcgccattggaataaccgcttgttacgacacccaggcggccaaatgggcagcgccagtgctcatctacgtgtgggtagggacctacgatgcgacgatcggacctctgacctacgtcattgtctcggaaacgtcgtcggtcaagctgaggtccaaaaccattgctctggcaagcatcaccaactccatcatggtcctggtgctccacatttccgtgccttacatgatgaacgaggaggaggcgaatatggacgggtttgtggggttcatctacgcccccttttgcctgctggcaatagcctgggcgtggtggcgactgccggagctgaaggggatgagttttatggagattgacatgttattcggcaacgagacgggaacccaaagagcgccgctggtttttgatggtcagaagcgcgaacgacaacctctagagtcacttgacggtctcggatggaggttcggaggtcaacaggacttgtcagagacaaatgacaataatgagggctccagagaggaacggctgtcgaatccttattgctcgtccaatgaagataatcgaagcgacagattccagccctcagaacgtggatgtatattagacagtccaaagaggaagcatgcaatcgagaagaacggagtggtgatcaccgagactctggaaatgggtgaaaatgctgataggtga

SEQ ID NO: 312 - protein, 579 aa, Yarrowia lipolytica
MSHRPWDCLPLWNTVVVFRRCVLWSLVMCFVIVMDGYDGFLIPSFYAVPSFQRRYGVQLPDGSWTVEAKWQTAYMVGAPIGRIAGALGVGVLADRFGRKRVTLVGLFCLSGITFIVFFAVGKAMLVVGWFLSGLIWGIFNTMTPTYVSEICPVSLRSTFAAAINLSWVVGQFISTAVITASESRQDEWAYRVPLAVQWVFPVVLIPLVMVMPESPWWILKHGDKKGARQVLTRLMDEKDVDIDMYLEYMRQTLEDEVDGGSFVDCFKGSDVRRTEICCLTYFFQPLSGLYILSYAAYFLQLTGIPQNVVFKLTLGLTGLAVMASLVAPIVILTFTRRSIYMGSLALMAATLFAIGITACYDTQAAKWAAPVLIYVWVGTYDATIGPLTYVIVSETSSVKLRSKTIALASITNSIMVLVLHISVPYMMNEEEANMDGFVGFIYAPFCLLAIAWAWWRLPELKGMSFMEIDMLFGNETGTQRAPLVFDGQKRERQPLESLDGLGWRFGGQQDLSETNDNNEGSREERLSNPYCSSNEDNRSDRFQPSERGCILDSPKRKHAIEKNGVVITETLEMGENADR

SEQ ID NO: 313 - DNA, 1329 bp, Yarrowia lipolytica
  CDS (1)..(1329)
atggtgccgtctttctacgcgcttcccgtgttccagaaaaagttcggcatccagctccccaacggagactggacagtggaagccaagtggcagacggcgtttctggtgggagtccccattggcagaatcacaggtgccgtgggagtcggtctgctggcagacagattcggcagaaagaaggtgactatcacgtctctggcattcatggtgggagtgacctttgttgtgttttttgccaccggcaaggaaatgctgtgtgccggctggatcatcagtggaattatctggggcgttttcaacaccatggccccgacctacgtctcggaagtgtgccccatcaaaatgcggagtcttttggcagccgctatcaacctgtcctgggtcgccggacagttcatttccaccggagtcgtcacaggtacgtccaccagaaccgacgactgggcatatcgagtaccgctagcagtgcaatgggtgtttccggcaattctgattcccacattgtgctttgccccagagtctccgtggtggctcttgcgacggggagagattgacaaggcaagaaacgcactggctagactggcagacgagaccaaaattgacctcgacgcgcatctcgaacacatgatccagaccgacaaggaggaagacaagtcaggaacgatagccgagtgcttcaagggtccagatctccatcgtaccgaaatctgctccatggtgtactccatccagccgctgtcaggagccaacattattaacttcttcgccttcttcttccaactgacaggagtgccccaagacattatcttcaaactcaccctgggacttacaggtttggggtttttggctactctgctgtcgtctgttcccatcgctcgagtgggaagacgcaaaatcatgctcacgggactgtttgttctgacggtggctctttttgccatgggtattctgggctgttttacatcccggggaaccaactgggctaccgcaatcttgctatttgtgtgggtcggcacgtacgacctgtccattggtcctggagcttttgtgatttactcagagtcgtcgtctgtgcgtctgagatccaaaaccatcgccattgcctccgtcatttcctcgacagtgactcttgttttcaacgtggctgttccatacatgttgaacgaggctgaggccaacatgcgaggacttgtggggtttgtgtatggtccgctgtgtatactgtctctgatctgggtctattttcgtcttccggagctcaaggggctcagttatatggagattgatcggttgtttgagggcaagaaggttgctaaagatggtgtctag

SEQ ID NO: 314 - protein, 442 aa, Yarrowia lipolytica
MVPSFYALPVFQKKFGIQLPNGDWTVEAKWQTAFLVGVPIGRITGAVGVGLLADRFGRKKVTITSLAFMVGVTFVVFFATGKEMLCAGWIISGIIWGVFNTMAPTYVSEVCPIKMRSLLAAAINLSWVAGQFISTGVVTGTSTRTDDWAYRVPLAVQWVFPAILIPTLCFAPESPWWLLRRGEIDKARNALARLADETKIDLDAHLEHMIQTDKEEDKSGTIAECFKGPDLHRTEICSMVYSIQPLSGANIINFFAFFFQLTGVPQDIIFKLTLGLTGLGFLATLLSSVPIARVGRRKIMLTGLFVLTVALFAMGILGCFTSRGTNWATAILLFVWVGTYDLSIGPGAFVIYSESSSVRLRSKTIAIASVISSTVTLVFNVAVPYMLNEAEANMRGLVGFVYGPLCILSLIWVYFRLPELKGLSYMEIDRLFEGKKVAKDGV

SEQ ID NO: 315 - DNA, 1602 bp, Yarrowia lipolytica
  CDS (1)..(1602)
atgttctggaagaacatgaaaaatgagccgcgccaggttcttaactcgacactatggctttccgtcattgtctttggtcttctgggctctgcccgaggtttggacgaaggcatgattgctggaacaacttcacaggcctccttcgagcatcaattcaatctcaaagaccccacaaagaccgccaaccaacaggccaacgagctgtccaacatcacagccatggtgcagattgggtctgttggaggggctctgatagccatgtttgtgcaggatcgaattggacgaatcagatgtctgcaagagatgatcattctgtggacggtgggggtcattatagaggtgacttcctactctcaaggacaactattggcaggacgattcgtggcgggacttggaatcggccagtcggtggtggttgggcccacctatctggctgaagtggcccccaaaaacgtccgaggactgtgcacttgcatcttttcaggctcagtctatctcggcgtcatgttggagtactttgccaactactccaccactttgcacatgtctccaaacagccgaatccagtgggtgctgccgactgctgtgcagttcatttttgcaggtcttttgttcattggttcgtttttcatcaaggagtctccacggtggctgatgaagattggtaaggacgaactggcagtggagacactatccaagatcagacacctgccggtggacgatctctacgtccagggagaaattgtagacgtgagagaacagattgagcgagagaagcaggcgctcagcggaaccagcatattgtctcttctcaaggaactcgtttccaccaaggccaatcgatatcgcctgtttttgggaatcatggtacagctcctgggacagtggtcaggggccaatgctgtgactgtctactctccaaagttcttctccatgctcggaatcccctcgaaaacggaccagatgatgtacacagcggttctgggtgtcatcaagttcacctcggccatctgctgtgccttgttcctaattgacaccattggacgccgaagaagtttgtacacgggcatctgtctgcaatttgtctccatgttgtaccttggcatctatctcgccattgtgcctgcaacagttggagtagatcgatcaccgtcccagaagaaggctggaggagccgccattgctgccatctacctgtctggctgcgggtgggctctgggatggaattcgatccagtatctgatcaacgcagagatctacaccgttcgtcacagatctctggcgtcgggaatcatcatggtattccactttgccaaccagtacggcaactccaaggcgcttccgttcatgcggtctggtatcaccgaccatggcagcatgttcttttttgcgggagtgttgcttcttggactggcctggtcgtggttctttctgcccgaggtgtctggacggtctttggagagcattgatgagatgttttcgctgccctggtaccagattggaagacggggacacaagctggttcctgaaacgggcacggtgattcagatccaggaggaggaggagaagaaaggaggtgttattcatgtggagaattgttaa

SEQ ID NO: 316 - protein, 533 aa, Yarrowia lipolytica
MFWKNMKNEPRQVLNSTLWLSVIVFGLLGSARGLDEGMIAGTTSQASFEHQFNLKDPTKTANQQANELSNITAMVQIGSVGGALIAMFVQDRIGRIRCLQEMIILWTVGVIIEVTSYSQGQLLAGRFVAGLGIGQSVVVGPTYLAEVAPKNVRGLCTCIFSGSVYLGVMLEYFANYSTTLHMSPNSRIQWVLPTAVQFIFAGLLFIGSFFIKESPRWLMKIGKDELAVETLSKIRHLPVDDLYVQGEIVDVREQIEREKQALSGTSILSLLKELVSTKANRYRLFLGIMVQLLGQWSGANAVTVYSPKFFSMLGIPSKTDQMMYTAVLGVIKFTSAICCALFLIDTIGRRRSLYTGICLQFVSMLYLGIYLAIVPATVGVDRSPSQKKAGGAAIAAIYLSGCGWALGWNSIQYLINAEIYTVRHRSLASGIIMVFHFANQYGNSKALPFMRSGITDHGSMFFFAGVLLLGLAWSWFFLPEVSGRSLESIDEMFSLPWYQIGRRGHKLVPETGTVIQIQEEEEKKGGVIHVENC

SEQ ID NO: 317 - DNA, 2364 bp, Kluyveromyces lactis
  CDS (1)..(2364)
atgactactgattctgttccacgaaagaatatttctcaagctatcaaactagtgtttcttcgacggaaagcacaagagcgtaacgaggcaggctcctctgaagtaccgacgggtggtaaatcgaataatgcttccgctacatcgtcacccgaagaggcacttgagaatagtggagaaaacttcgaactcacaaatttcgcatctttatcagaaatggaatcagaaatctttcttgcacctcccgccaaacaatcgaagaagatctccattcttgttggtatgtttgttgctgtgggtggatttttgtttgggtatgatacaggattaataaataatatcagcgaaatgccttatgttaaccaaaagtttgcacctaacaagaatcatttcacaacaccacaaatctcgatattagtgtcttttttatccttggggacgttcattggagccttactggcacctttaatctccgactcttatggtcgaaagactacaatgatctttagtacgttcgtggtatttatgataggaaactctttacaggtggcagctggttctatgaccatacttgtagttggaagagtcctctctggtatgagtgttggactaatatcggctgcggtgccattatatcaaagtgaagctgcacagaaatctgttcgtggtgcaattatttcctgttaccagtgggccattacatgggggctacttgtagcaagtgcagtttcccaaggaacatataaaagaatggatgcatctagttaccaaataccgatcggattacagtatatttggtcctttctactcggtgtcggcattcttttcctccctgaaagcccaagatactatgttttcaaagataggctagacaaagcggcaaaatctttatcctttttacgtggcgtaccagaggatgactccggattacttgaagagttggttgagatcaaagcaacatatgattacgagatgtcattcggaaaaatctcttacctagattgtttcagatcaacgagatcaagaaccaaacagcgtctacgaatgttgaccggtatcgctcttcaggcttttcagcaagtgagtggtatcaattttatcttttattatggcgtagactttttcaataagagtggtgtcagcgaaagctatttggtttccttcgtcacatatgcagtaaatgttgcgtttaacattccggggttattcttggtcgaatatatcggacgaagaaaattgttattgatgggtggtattcttatgactatctccaatttcattattgctatagtcggattagcgactgactccatggttgcgaacaaagtgatgattgcattcatctgtttattcattgcatcattttcggccacctggggtggtggtgtgtgggtaatttccgctgaattatatccattgggtgttcgcgctaaatgcaccgccatctgtgcagcatcaaactggctaataaatttcatctgtgcattaataacgccttacattatgcacatagatagcagtgtcagacaaacgagtatcggtaccaaaatcttctttgtttgggggtcattgaacgctgttggggttcttgttgtgtacttcaccgtgtacgaaacgaatggattatcattggaagagatcgatgagttgtacaagaaatcttcttctggaataaactccatagaatggaacaagaagatcaaagcctttccagatttgtttcaaaggacaagaccgaacaatgaaggtgacggagaagctgatgataacatacatacagatgaaaattataaccatactatttccagctataatggaacccaaaacaatgaaaaatatcctattcaagtacagatgccacaatttggtgtacggaacatcgaatttttgaacaccacaggctcatctccgcaatcggatatgacagaacccaactttgtcgacttgggtaatggtcttggtataacaacgtatcaaagaggcccaccatccgtccttactgactcgagtgaagaagaggaagagggacaacaacaagagacagatgagactgaggaaggtaaatcattcaaacaccagtacactgacgctcgtaataaaaatcgtggcgagcgcggcagtttcaatagcaatagttcaacctcaggcactactcgatcttcttcccacaaggccagtgttcaaaggatggaagaaattaatctgtacatggcccaattaatgcatcgcggaggaacagaagatctttcgcgtaacactaccgataacactcatcaaccgatatcacatgatatcatgagtcaatggaactcctcatcccaaaataaaggacctagcactcaaaccgatattaatagtaacacttag

SEQ ID NO: 318 - protein, 787 aa, Kluyveromyces lactis
MTTDSVPRKNISQAIKLVFLRRKAQERNEAGSSEVPTGGKSNNASATSSPEEALENSGENFELTNFASLSEMESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 319 - DNA, 1434 bp, Kluyveromyces lactis
  CDS (1)..(1434)
atgccagactatctaaacgcgatgggtaatcctaacggtgcagagttgggtgttatctccaacggtatgatgtttggtatgcttttgtgcttccaatttgcaccatatgtcattgacaagtatggccgtaaggtcgggatgtacgtgggtaatgtcttgatttgcattggtgtcctcatccaagcagtatctggtgcatggatcaatggtttaccagaggattatgacaagaaggacgtgttcggtatgtttgttgcttcacgtatcgtgttgggtaccggagttttgttgatcagtatttcgactccagctttgatctcagaaatatcataccctcctcacagagagctttgtacctccatatataatacatgttggtaccttggtgctgttgtctcagcttgggtcacttacggctgcagaaacctagctcatcattggaactggagaattccatctatcattcaagcttttttccctatcgttcaactcattgtgctatacaactgcccagaatctccaagatatcttgttttccataacagagattccgaagcaagggccattttgaacaaataccatgcaggtgataatgaggaatacgcgggcttgatcgattttgaattggcagaaattaaactggctattgaacaagaaaaagcttctcaagctaccaacttctctgatttctttaaaacctccggtaatcgccatagattgtggattttgatctggactgcaattttcacacaactttccggaaatggattggtgtcttactatctatccaaagtcttcaattcgattggtattacagatcctgatgagcaattagagtggaatggttggttaatgctttacaactggttatgttcattaattttgatgagttacatcgccccattcttcaaaagaaggcaattatttttgatatccttgacttcaatggcctgttgctacattgtctggacagctttatctgctgaaaaccaaaaacgtaatttcgaggataaatctctagcaaatggtgtcttggcaatgatcttcttatattatctttcttacaactttggattcaacggttacccattcctctacacaactgaaattttaccttacactttgagaggtaaagggcttacaattttccagttggccattagtcttgcagttattttcaacgggtttgttaactcaattgcaatggatgctattgaatggaaatactacatcttttattgttgtttcttagccgttgagattgttgtctgttatttcactttcgttgaaacttctggaagatctttggaagaagttgacgaggtgtttggagatggtatcactcaactcccagaagtgacatcccaggttatgttagaagatggtaagaggttatctgttgaacatctagaaagaacagaaacctcatcctaa

SEQ ID NO: 320 - protein, 477 aa, Kluyveromyces lactis
MPDYLNAMGNPNGAELGVISNGMMFGMLLCFQFAPYVIDKYGRKVGMYVGNVLICIGVLIQAVSGAWINGLPEDYDKKDVFGMFVASRIVLGTGVLLISISTPALISEISYPPHRELCTSIYNTCWYLGAVVSAWVTYGCRNLAHHWNWRIPSIIQAFFPIVQLIVLYNCPESPRYLVFHNRDSEARAILNKYHAGDNEEYAGLIDFELAEIKLAIEQEKASQATNFSDFFKTSGNRHRLWILIWTAIFTQLSGNGLVSYYLSKVFNSIGITDPDEQLEWNGWLMLYNWLCSLILMSYIAPFFKRRQLFLISLTSMACCYIVWTALSAENQKRNFEDKSLANGVLAMIFLYYLSYNFGFNGYPFLYTTEILPYTLRGKGLTIFQLAISLAVIFNGFVNSIAMDAIEWKYYIFYCCFLAVEIVVCYFTFVETSGRSLEEVDEVFGDGITQLPEVTSQVMLEDGKRLSVEHLERTETSS

SEQ ID NO: 321 - DNA, 1719 bp, Kluyveromyces lactis
  CDS (1)..(1719)
atgtccgaagagaaaaaggttgttaatgttccttcaaactctgaaaaagaaagcgcacttgtcgaagttgaatcaagatcaactattgatgaaatcgaaaatgtgtttaatggcaacaaaccaacagaagaagttctgaaagaagttgatgaattggtcttgaagtatgatcttcaagaataccaagaactattaagtcgtggtgctttattggctaatgatcctgatgttttgctaactgataactactccgaaaaggaaagaaaaaagatcggcagggagttaacacatccatttctgtctttgtcaagaggtatgatttgggctgcgttatgtacctctttggccgccgtcaatttcggtatggatgaaagtgctgtcggtggtgctgtcttgggttatcaaaaggcgttcaacattacaaaccctaacatccaaggtcttactttagctgcgccttatttggctgctggtgtcttgaccttaccactgactgtcttattgaacaaaaaatttggtagaagatttattgttttgataagttgttttatcggtgtgtctggttctctgatccaaggcttttcgaacggattaggtcttatattgttcgcaagattatatttaggtattggtatgggtttatgttcatctactgtcccaatctatactgcagaatgtgcaccagcagtttctagaggcgcaattttaatgttgtggcagacttttatcgctcttggtgtttgtttgggttcagttttcaatagagcttttgtcgaaatcgaggggaacctatcttggagattaatgattggttcttcttgtgtagcaccctttatcacggctctcgtggtttacattccacctgaatcaccaagatggcttattggaaacggatttgtcagagaatccctagagtccctaatcagattgagaaacacagaagtctctggttcacgggacttttatatcctatatgagtctttgaaatacgaacataaacttgcagctaaactttcttggcaccaagagattaaatccctattcagtaacatcagaaacagatttgctttgtgggtatcgttccttggtattcttggtcagcaatacggtggcgttaacatcttggtttcatatactgcaacaattttaacgaatgctggtattgacccggtaactgccattgctggctcaatcggtattggaggtggttgtttcttagctactttcctttcctcgcagttgatcgacagatttggtagaagaacaatgttgcttttgacacttcctgtagaaggcgcttgtttgttttggttgggtggtattttgaatatcaaagaagatcaagctcggttggctgctggtttggctgctatgtatgtatttgtgctgttctacggtattggtattgggccaattagttttacattggtagcagaaaccccatccattaccgttagaatggctcatagtgcttttgctatgtcgatcaattggttgcttgatttctgtttgacgatgacatggccaaaaatggccgattctatgggaacttcaggagggttatatttctacggtgcgtttaactttctgatttgggttcttgcttatttcacaatcccagaaacaaaaaggttcacactagaacagttagatgaggtgttcaaacatggtgttacccattatgccaagcaaaataccagaaaactatttggtaaataa

SEQ ID NO: 322 - protein, 572 aa, Kluyveromyces lactis
MSEEKKVVNVPSNSEKESALVEVESRSTIDEIENVFNGNKPTEEVLKEVDELVLKYDLQEYQELLSRGALLANDPDVLLTDNYSEKERKKIGRELTHPFLSLSRGMIWAALCTSLAAVNFGMDESAVGGAVLGYQKAFNITNPNIQGLTLAAPYLAAGVLTLPLTVLLNKKFGRRFIVLISCFIGVSGSLIQGFSNGLGLILFARLYLGIGMGLCSSTVPIYTAECAPAVSRGAILMLWQTFIALGVCLGSVFNRAFVEIEGNLSWRLMIGSSCVAPFITALVVYIPPESPRWLIGNGFVRESLESLIRLRNTEVSGSRDFYILYESLKYEHKLAAKLSWHQEIKSLFSNIRNRFALWVSFLGILGQQYGGVNILVSYTATILTNAGIDPVTAIAGSIGIGGGCFLATFLSSQLIDRFGRRTMLLLTLPVEGACLFWLGGILNIKEDQARLAAGLAAMYVFVLFYGIGIGPISFTLVAETPSITVRMAHSAFAMSINWLLDFCLTMTWPKMADSMGTSGGLYFYGAFNFLIWVLAYFTIPETKRFTLEQLDEVFKHGVTHYAKQNTRKLFGK

SEQ ID NO: 323 - DNA, 1536 bp, Kluyveromyces lactis
  CDS (1)..(1536)
atgacaagcgagaagactgttgaatatactgaggcagtaacaaaaattgattcttcctcaaggcagtatgaaaaatctacgaagaattttttcataaatctgaaggaatctttcaacttgaccatgactttgtcaagtctgttgttgatttgttcttctttctctcatggatttgataatcagggtttcgcgacgattcaggcaatggattcctttatagagaaattcggacagtacgatgcccaaacaggagcatacgctattcctccggtgtttttgtcgttcttgaatagtttccaatacatcggttttgcttttggtctagtctgcggaagcatagtgtcttctaggtttggtagaaaaatctgtgttctatcaatgagcctatatgcgctgataacagccactatcggaatcacatctaattctaaggaacagatattatcggctagagttctcaactatgtttttattggaatggaaatggcagtcattcctgtatttcaggcagaaattgttccaccaaacacaagaggattctttgttggtgcttttcagttgtcactcaatattggtgggttagttattcatatcatcacaaatagtacagcacatatagatggaacatcatcatggaggattcctctcggactttactatattttcccgagtgttattgcctcccttgtcatgtttattccagaatctccaaggtggcttattctgaagggtaagaaggaagaggcgatgcggtctctcgttcgtttgcgtaatggaacaatttatgaaagtgaaataatcaacgagtatgaaagcattatatcttctgtggaagcagaaaagcaagagaaaagtaaatacaccgaactcttcactggaacaaacaagagaagaaccttaatcgtaattctggcaaacatctttcagcaagtgactggtcaggcatttgcttcccaatatggtaccatattcatcaagtctttgaataccgtagatccctttcaaatgtcaatcgtgtcttctgtcgtagctattgttgcagtcatcatagttttgttgtttactgatgaatttggtcgcaaaaagttccttgtaattgggtcagttattcaggctatagccttattggtaatggggggcttggggacaggagatgtgaccactgccaaaaagaacggaattgttgcgacaatgatgattaacagctttgcttattgtatatcatgggcccctctctcttatgttataagtagcgaaatccccactccacgcttaagagacaaaacctacgctgttggcatcctctttaatattctgtttgccttcataactgcctttacgcttccctatctgctgtcgaagccgtatgcaaacctacaatcgaaggttggttttatttatggagcatttactgtactttctgttgtcttttcgtactatctgcccgaatgtcgcggtttgagtttagaggaaattgaatcaaatttcgtaaataaagtacctttaaaccggttctctaagaattcgattagttaa

SEQ ID NO: 324 - protein, 511 aa, Kluyveromyces lactis
MTSEKTVEYTEAVTKIDSSSRQYEKSTKNFFINLKESFNLTMTLSSLLLICSSFSHGFDNQGFATIQAMDSFIEKFGQYDAQTGAYAIPPVFLSFLNSFQYIGFAFGLVCGSIVSSRFGRKICVLSMSLYALITATIGITSNSKEQILSARVLNYVFIGMEMAVIPVFQAEIVPPNTRGFFVGAFQLSLNIGGLVIHIITNSTAHIDGTSSWRIPLGLYYIFPSVIASLVMFIPESPRWLILKGKKEEAMRSLVRLRNGTIYESEIINEYESIISSVEAEKQEKSKYTELFTGTNKRRTLIVILANIFQQVTGQAFASQYGTIFIKSLNTVDPFQMSIVSSVVAIVAVIIVLLFTDEFGRKKFLVIGSVIQAIALLVMGGLGTGDVTTAKKNGIVATMMINSFAYCISWAPLSYVISSEIPTPRLRDKTYAVGILFNILFAFITAFTLPYLLSKPYANLQSKVGFIYGAFTVLSVVFSYYLPECRGLSLEEIESNFVNKVPLNRFSKNSIS

SEQ ID NO: 325 - DNA, 2034 bp, Kluyveromyces lactis
  CDS (1)..(2034)
atgtctgatagtaccgataaagataggcataacaaaaattcgtccaggggtatcgtcaatacggatatcgaggatgacaatagtccatcacctttggacaccactgacaagaaaggtgctccggaattgcagaaaccgggaaatccatctttgttcaaggaatctgctttgaagaattctgatcagctacaatttagaaacagtttcaacattccaaatgccgttggcggaactaacggaattgtaattcctccaaatgttcaaccattagatcaacaacgtattccacctagctacactgatcacttacaggttaaggatacttatttgacgggaagaactctattgtacttcacatcgatatttgtgtcactaggcgtatttttgtttggctacgatcaaggtgttatgtctggtattatcactggcccatatttcaagacttatttcaataacccaactgcggcaactattggtactatggtctcaattcttgagattggagctcttgtttcctccttactagtctccaatattggtgaaaaattcggtagaaggttcactataaaatatggatctttaattttcattttaggtggattggttcagacgttttcatgggaaatgggtcatatgatatttggtagaatcattagtggtattggtgttggtttattaagtaccattgtacccatttatcaatcagaaattagccccccacataacagaggaaaattggcttgcattgagtttacaggaaatattgttggttatgcgtctagtgtttgggtcgattatgcgtgctcctatatagaatcagatacttcttggagattacccttgttcattcaatgtgttatgggcttgctgttatttttagggtcgtttgttattgttgagactccccgttggttattaaatcacgaccatgatattgaagggttggtggtcatagcagacttacatagtgatggtgacgttttgcattcaaaagctcatgaggagtataagctgatcaaggaaacagtcctcatatcaagactggaaggtgaaaagaaatcgttacgttttgcttttaaacggtatagaaccaggatgctaattgcaatgagctctcaaatgtttgctcaattaaacggtatcaacgttatatcatattacgcgcctcttgtttttgaacaagctggatgggttggtagagaggccttgttgatgacaggtattaattccatcatttacatattgtccactattttgccatggaaattagttgataaatgggggagaaaaccaatcctactctccggggcgctggtaatgggaacttctttgcttgcaatagccatgtcattatgggcgaatgttgctgccactccaagattagtggtcgtgttcgtgatcatctttaatgcctttttcggttacagttggggtccaatcccatggctatatcctgttgagattgcgcctgcaatggcaagatctgcaatggcatctgcttctactgctacaaactggctgtttaactggttagtaggtatcatgactcctatcttgcaagaaaaaatccattggagaatgtacttgattcatactgtatcctgctacttgtcattctggtgtgtgttaaaagtttatccagagactgctggtttaagattagaagatatggattctgtttttgatgacaggtcatcaaccttcagtttccagtcagggacctccgctgaaatagaacaacagtctcatctagtaagtggtggaggagaagtagcaccatcaacgagatctcgcaaaagtgtttattcgaatgcacaatccatgtttaataaagatgagatacaaccaccaacattgacccaggttcttcaatggaaggaagagagaactcaaactaaaccattgaaaaaatttataagaagaggctcggagactgtctgtttgatatataataaggtacgaaacttacggagcaccaatgatacaaaccaaatcgagtatggtgccgtatccaataatcagcctccgaactaa

SEQ ID NO: 326 - protein, 677 aa, Kluyveromyces lactis
MSDSTDKDRHNKNSSRGIVNTDIEDDNSPSPLDTTDKKGAPELQKPGNPSLFKESALKNSDQLQFRNSFNIPNAVGGTNGIVIPPNVQPLDQQRIPPSYTDHLQVKDTYLTGRTLLYFTSIFVSLGVFLFGYDQGVMSGIITGPYFKTYFNNPTAATIGTMVSILEIGALVSSLLVSNIGEKFGRRFTIKYGSLIFILGGLVQTFSWEMGHMIFGRIISGIGVGLLSTIVPIYQSEISPPHNRGKLACIEFTGNIVGYASSVWVDYACSYIESDTSWRLPLFIQCVMGLLLFLGSFVIVETPRWLLNHDHDIEGLVVIADLHSDGDVLHSKAHEEYKLIKETVLISRLEGEKKSLRFAFKRYRTRMLIAMSSQMFAQLNGINVISYYAPLVFEQAGWVGREALLMTGINSIIYILSTILPWKLVDKWGRKPILLSGALVMGTSLLAIAMSLWANVAATPRLVVVFVIIFNAFFGYSWGPIPWLYPVEIAPAMARSAMASASTATNWLFNWLVGIMTPILQEKIHWRMYLIHTVSCYLSFWCVLKVYPETAGLRLEDMDSVFDDRSSTFSFQSGTSAEIEQQSHLVSGGGEVAPSTRSRKSVYSNAQSMFNKDEIQPPTLTQVLQWKEERTQTKPLKKFIRRGSETVCLIYNKVRNLRSTNDTNQIEYGAVSNNQPPN

SEQ ID NO: 327 - DNA, 1596 bp, Candida glabrata
  CDS (1)..(1596)
atggagcaagtcactatcggtgttatatcattagattcatctcctacagaaaattacacgctgaacacagcagaaacaaggcaatcatttcagctctctggaaagagtgaagtaaataccataccgggagaaaaatatgaagaactaaagatgaagtacatacgccagcacactaaagcagtagtattatgttgtttaatatcatttggaggaatgatactaggctgggacatcggtaccgtgggtggtgtgtcgataatgccaagtttcaataatgcattcggtgatcaaacgacgattgtgtcctctgcaaaggaactctcaaatatgaaaagaggtctttacatttccatattcaacattggatgtgccttaggtggtattatgttttctaggttatcaaatactgtgggtcgtagagtaggaattctaaccgctatagcaaagtatactcttgtcctgacggtccagttattctcaaatggaaactttatccttcttctggcatctagatttgtattgggagtaactgttggcgcaataagtgttttggtgccgatgtttgtatcagaaagtgcgccaattaaaattcgaggagcattagtggtagtctatcaactagcaataacattgggaatactctttggaaatatactaaactacatgactaacaagcatttgtctatggtagatcccatgaacaatatggcatggaaaattccgatgctattcggttacctttgggctgccattgttgcagtgggcgcttgtattaccccggaatctgtccatttcctagccaaaattcgtaatgattatgaaagtgccaaaatatcatattcgatcatgaacaatatttcagtatttgaccatgaaactatcgattatgttaacaacttgctagtaaagcaagatgtgtataatgagaacgaccttaggaaccataaatttgagtttttatatggtaagccaaaatatggaaaacgcctacttattggcatcatggtgatggcctttcaacaactttctggtataaactacttcttctattatggaacctcattattcaaaagtgttggaatcaaagatacatacgccacggctatcatactttcatcagtcaattttattagtacttttgcaggcatctacttagtggaaagccttggaagaagatctacactaatttatggctcatttggcatgttcatatgtatgatattttatgcgtcttttggaactttaagtttgagaaaggatctattatcattcgtactgatcattgttacatgcttatttatctcgatcttcgccataactatcggcccagtatcatttgtagttgtagccgaattgttcccaacaagaactagatccgtttcaatgtctatatgctcttcctttaattggctagttaatttcgccattgctctggcaacaccagtgataatcaatagaataggcttcctttatgggtttttctttgcaggttgtcttctattagcaactggatttgaagcattctttgtaccagaaactaaaaataaaacagaagaagaaatagactatatgttccaaaacaacttgaaatcgtga

SEQ ID NO: 328 - protein, 531 aa, Candida glabrata
MEQVTIGVISLDSSPTENYTLNTAETRQSFQLSGKSEVNTIPGEKYEELKMKYIRQHTKAVVLCCLISFGGMILGWDIGTVGGVSIMPSFNNAFGDQTTIVSSAKELSNMKRGLYISIFNIGCALGGIMFSRLSNTVGRRVGILTAIAKYTLVLTVQLFSNGNFILLLASRFVLGVTVGAISVLVPMFVSESAPIKIRGALVVVYQLAITLGILFGNILNYMTNKHLSMVDPMNNMAWKIPMLFGYLWAAIVAVGACITPESVHFLAKIRNDYESAKISYSIMNNISVFDHETIDYVNNLLVKQDVYNENDLRNHKFEFLYGKPKYGKRLLIGIMVMAFQQLSGINYFFYYGTSLFKSVGIKDTYATAIILSSVNFISTFAGIYLVESLGRRSTLIYGSFGMFICMIFYASFGTLSLRKDLLSFVLIIVTCLFISIFAITIGPVSFVVVAELFPTRTRSVSMSICSSFNWLVNFAIALATPVIINRIGFLYGFFFAGCLLLATGFEAFFVPETKNKTEEEIDYMFQNNLKS

SEQ ID NO: 329 - DNA, 2571 bp, Candida glabrata
  CDS (1)..(2571)
atgacgatcatatcggaggatgagaagagtgtggcccgagatagagagggtgtgttggctcgggctatcaaagtggtaaacaggaagttcaggaggaaagatgtacggcgggaaaagctagagcgagcgcttagctgtgataaccagatgacgttgaactctacgaatctctacgcggcgcagcagcaagagtatcagcggagggaggagaatgatatagaggagaaccaggagccggagggtggtaatgacgatatagactacgacatctcaatactatcggacgagatgtctaccgtggacgacgcatctctgctttttgcggagccaccgcagaagcagtcgcatatgatgtctatagtggtgggtgcgtttgttgcagttggtggatttctgtttggctacgacacggggctcataaacagtatagtagacatgaggtatgtgcgggagaatatcgcgccaaatcacgttggattcacggcgcagcagctggccatattggtttcgttcctatctctgggcacttttgtaggtgctctgtcggcaccggtgatatctgataaatacggcaggaaaaagacaattatgtttagcacagcggtggtgttctcacttggtaattccttgcaggtgggggcacataacattcaattacttattgcaggcagagttatatctggtctaggtgttggcctggtatccgcagttgtaccattatatcaagcagaggctgctcataaatcgctgagaggtgccatcatttcaacttatcagtgggccatcacttggggtttgttggtgtcaagtgcagtatcgcaaggaacacataatagaaatgacgcttcctcgtataggatacccataggtcttcaatatgtctgggcatatatattagcagctggtatgctatggcttccggaaagccctcggtattatgttctcagagatcaactagacaaagctgcacaatcattatcattcttaagaggagttcctatccatgattcaggactactagaagaacttgtagaaataaaggcaacatttgactacgaatcatcattcggcaaaacaaccttctgggactgttttaaatcgaataagagtagacctaaacaaacacttagaatgtttacaggtattgctattcaggcattccagcaattttcaggtatcaattttatcttctactatggtgtaagtttcttcaatagatctggtgtcgaaaacagctacattgtttcattaataacgtacgcagtaaatgttgggttcagtgttcccgggatgttcctggtggaatattttggtagaagaagtgtgttgctatatggaggtgcgattatgactctatcgaatttcattatcgctatagtaggatcctcgacacaatccgtcgtggctaataaagttatgatagctttcatatgcttattcattgcatcatttgcggcaacctggggtggtgtagtgtgggttatatctgccgagttataccctcttggagtcagagccaaatgtactgccatctgtgcggcagctaattggctgattaattttgtttgtgctttcataactccttacattgttgatacgggcgaaagaagagcattgattggaccaaagatttattttatttggggtagcttgaacgctctaggtattctggtggtatatttcactgtttatgaaaccagagggctaaccttggaagaaatagatgaactatatacaaaatcacccaacggtattgtatcagctaagtggaataggagaataagacacagagaaaaaacatatggccacaaggagcaacaaaatagagatagaaatcaacaaactaccaaggaaaacctacgtaagaatgttgtaaatgaagacatgctaagtgatgacctaactcctcgcaatgactctataaacacccatcatagtgttgattctaatgaaaagtatcaaagtgaaaacaccgataacactttagcacccgcagttaacgataggagtatgatggattttggcaatgacatgatattacatatatgtaatagaggtcctccatctatctccactgcagctagtgtagaagagtttggcggaaactcaacccaaatggagaacctcagttataatgaaagtaacagtgtcgaaaagaaaaaagtgggcttgttttccaagttcaagctgggttcacgaaagtcttccattaatgggactgaagaagacagcaaaccaaaatctccgcaactgggtcaagccgaattttctccatctccattagatgtgaaggtatctgatgatgatcacaatgacttcgttgatttaggcaatggttttggtttgtacagtgttaccagaagactttcctcaggagtacctgatacaagtgacgaggaatctgcatatgatcttggtaatgcaccatcatcaacaaatacttatagaaatagaggtaacctggattcaataaacacgtatatgtcacaattaattcagagtaatacctataccagccaaaatacagggtactcacaaaacgacaacgatcagacgcagcaccatcaatga

SEQ ID NO: 330 - protein, 856 aa, Candida glabrata
MTIISEDEKSVARDREGVLARAIKVVNRKFRRKDVRREKLERALSCDNQMTLNSTNLYAAQQQEYQRREENDIEENQEPEGGNDDIDYDISILSDEMSTVDDASLLFAEPPQKQSHMMSIVVGAFVAVGGFLFGYDTGLINSIVDMRYVRENIAPNHVGFTAQQLAILVSFLSLGTFVGALSAPVISDKYGRKKTIMFSTAVVFSLGNSLQVGAHNIQLLIAGRVISGLGVGLVSAVVPLYQAEAAHKSLRGAIISTYQWAITWGLLVSSAVSQGTHNRNDASSYRIPIGLQYVWAYILAAGMLWLPESPRYYVLRDQLDKAAQSLSFLRGVPIHDSGLLEELVEIKATFDYESSFGKTTFWDCFKSNKSRPKQTLRMFTGIAIQAFQQFSGINFIFYYGVSFFNRSGVENSYIVSLITYAVNVGFSVPGMFLVEYFGRRSVLLYGGAIMTLSNFIIAIVGSSTQSVVANKVMIAFICLFIASFAATWGGVVWVISAELYPLGVRAKCTAICAAANWLINFVCAFITPYIVDTGERRALIGPKIYFIWGSLNALGILVVYFTVYETRGLTLEEIDELYTKSPNGIVSAKWNRRIRHREKTYGHKEQQNRDRNQQTTKENLRKNVVNEDMLSDDLTPRNDSINTHHSVDSNEKYQSENTDNTLAPAVNDRSMMDFGNDMILHICNRGPPSISTAASVEEFGGNSTQMENLSYNESNSVEKKKVGLFSKFKLGSRKSSINGTEEDSKPKSPQLGQAEFSPSPLDVKVSDDDHNDFVDLGNGFGLYSVTRRLSSGVPDTSDEESAYDLGNAPSSTNTYRNRGNLDSINTYMSQLIQSNTYTSQNTGYSQNDNDQTQHHQ

SEQ ID NO: 331 - DNA, 2289 bp, Candida glabrata
  CDS (1)..(2289)
atggattctagcttcgaaatactcccgtaccgtggtgacgatcaaataccgagagttgatagtggcgggttgcgaagacgagcatcacagacaataaatactaatcatgatgacacttgtgttgatatagatgcctacaatagtggtatagatgtgtcaagtaagaatgagtatcttggaatcaataccgcagacgatgataatgaatatggtaacggtggaatgcaaaattatgaaggacctgtgaatgagcaagctatccattgtcaaaccaacgatatatcagaaaatgaaaataatctacagttgcttggacagccattgccacttcgttcaactatgatgaccacgtttgtgggacttttcgttgccgttggtgggtttttatatggttatgatacaggtctgataaatagtataactgatatgaaatacgttaaagaacacattgcaccaaatcactcattctttactacaacacagatatcgatgctggtgtcatttttatcattgggcacatttgtaggcgccctcattgctccatggatttcagatatttatggaagaaagtcaacaattatattcagtactatgatcatcttttcgataggtaactctctgcaagtagcagctggcgggctggcattgttaattgttgggagggtaatatctggtattggaataggtataatatctgctgtagttcccctttatcaggctgaagctgcacagaagcacatgagaggagccattattactacctaccagttggctattactttaggattactcgtttcaagcgcagtgtcacaaggcacagagtctatcaatgctccgagttcatacagagttcccataggattacagtatgtctggtctgttgttttaggtgttggaatggtttttttaccagaaagtcctcggtattatataatgaaggatgagatagaagaagcagcgagaagtttatcgttcttgagaggtatctctttagaagatccaaggctcttagaggaactagtcgaaattaaagctaactacgattatgaatcctcatttggtcctgtatcaatatgggattgtttcagatccagtgagcaacgtccaaagcaggtgctgagaatgtttactgggatatctatacaagctttccaacaattttctggtattaatttcatcttttactatggtgtttatttcttcaacaagacaggtattaaaagtagttacctggtgtcgtttgtcacttatgctgtgaatgttgcattcaacataccagggatgtttttaattgactatttagggagaagaaaagtattaatcttcggtggcattgcaatgactgcttgcaactttattattgccattgtgggtgtttctgccaaatccattgtttcaaataatgtaatgattgcatttatttgtgttttcatagcagccttctcgagtacatggggtggtgttgtatgggtaatctctgcagagctatttcccttgggtgtgagatcaaagtgcactgctatatgtgcggcagccaattggctagttaactttgtctgtgcattgatgactccttatattgtcgatacaggatcaaactacacatcttcgatgggtaccaagatatacttcatttggggaagtctgaatgcccttggaactatagttgcatatctgacagtgtatgagacgagagggttgacgcttgaagaaatcaatgagttgtacgttaactcacccacaccatttgcgtcgaacgaatggaatagaaagattcgcacagaatccacgatcccacctatggtacatgaccatgaactagataaccacattgtgccaacaatggacaacattctccatagcagaaatccaaaccagccatactcttcagatgagaaccaagatgttatagtaggggaagacaagctggacttggagcaaggctacaataaggagattcacaaccacagggatgataacaacgtatcgccaataccattcctccaggaacaaaatgggaaagaattcagcaatggtgctgatttcagcccatcgacacactcaacttttgccttgaccgagcacataccagcgaactacgtggaattggggaacggatttggattaaacacatacaggggcgggcccccatccatctccgattctagtgatgacgatcattgcacacactggcaaagcccagagaatggatcacctatataccatgaaattctgtcctctaacgacacgaatagtggcacttacaacaagaactctgaaaatttatag

SEQ ID NO: 332 - protein, 762 aa, Candida glabrata
MDSSFEILPYRGDDQIPRVDSGGLRRRASQTINTNHDDTCVDIDAYNSGIDVSSKNEYLGINTADDDNEYGNGGMQNYEGPVNEQAIHCQTNDISENENNLQLLGQPLPLRSTMMTTFVGLFVAVGGFLYGYDTGLINSITDMKYVKEHIAPNHSFFTTTQISMLVSFLSLGTFVGALIAPWISDIYGRKSTIIFSTMIIFSIGNSLQVAAGGLALLIVGRVISGIGIGIISAVVPLYQAEAAQKHMRGAIITTYQLAITLGLLVSSAVSQGTESINAPSSYRVPIGLQYVWSVVLGVGMVFLPESPRYYIMKDEIEEAARSLSFLRGISLEDPRLLEELVEIKANYDYESSFGPVSIWDCFRSSEQRPKQVLRMFTGISIQAFQQFSGINFIFYYGVYFFNKTGIKSSYLVSFVTYAVNVAFNIPGMFLIDYLGRRKVLIFGGIAMTACNFIIAIVGVSAKSIVSNNVMIAFICVFIAAFSSTWGGVVWVISAELFPLGVRSKCTAICAAANWLVNFVCALMTPYIVDTGSNYTSSMGTKIYFIWGSLNALGTIVAYLTVYETRGLTLEEINELYVNSPTPFASNEWNRKIRTESTIPPMVHDHELDNHIVPTMDNILHSRNPNQPYSSDENQDVIVGEDKLDLEQGYNKEIHNHRDDNNVSPIPFLQEQNGKEFSNGADFSPSTHSTFALTEHIPANYVELGNGFGLNTYRGGPPSISDSSDDDHCTHWQSPENGSPIYHEILSSNDTNSGTYNKNSENL

SEQ ID NO: 333 - DNA, 1668 bp, Candida glabrata
  CDS (1)..(1668)
atgtcacaaagtgccatttcatccacatccgctactgatcctgagagacagaccccagaaactaagctggaaggcgaagatttccaactgaaggccgatgaagccagtattcaaggcgctgagattccaagaaagcccttaggcgcttactggaccgttatgtgtctatgtttaatgattgcctttggtggttttgtctttggttgggatacaggtactatctctggttttgttgctcaaactgatttcaaaagaagattcggtcaaagacactcagatggtacttactacttgtcaaatgttagaactggtctaattgtcgctatatttaatattggatgtgccttcggtggtctaactttaggccgtactggtgatttgtatggccgtaagaaaggtctagtcattgttgtttctgtctatgttgttggtattattattcaaatcgcttcggtagacaaatggtaccagtattttattggtagaattatttctggtctaggtgttggtggtattgccgttctttctccaaccttaatttctgaaacagctcctaaacatctaagaggtacttgtgtttcattctaccaattaatgattactctaggtattttcttgggttactgtacaaactatggtaccaagaattattctaactccgtccaatggagagtcccattgggtctatgttttgcctgggctttgttcatgattggtggtatgtccatggttccagaatctccaagatttttggttgaaaaaggcagattagaagaagccagacgttctattgctatttccaacaagctttccatggatgaccctggtgtaaccttcgaattagatactataagcgcaggtgttgaagctgaaagacttgctggtagtgcctcttggggtgaattattttctaataagggtaagattctacctcgtgttattatgggtgtaatgattcaatctttgcaacaactgacaggtaataactactttttctactatggtaccacaattttcaaggctgtcggtttggaagattcattccagacatccattgtcctaggtattgttaacttcgcttctacatttgtgggtttatggactgtcgagagatttggccgtcgtagatgtttgttgtggggttctgcaactatggctgcttgttttgtcatctttgcttcagtcggtgtaaagagtctgtatcctcacggtagagaccatgcatcctctaagggtgccggtaactgtatgattgttttcacatgtttcttcattttctgttttgctactacttgggctccaattgcctacgttattgtctctgaaacttatccattgcgtgttaagaaccgtgccatggctattgctgttggctctaactggatttggggtttcttgattggtttcttcactccattcattaccagtgcgattaacttctcttatggttatgtattcatgggttgtttggtattctcttacttctatgttttcttctttgtctgtgaaactaagggattaacattagaagaagttaatgatatgtatgaagaaggtgtcttaccatggaagtctccaaactgggttccaccatctagaagagatgcttcttacgatatcgacgctatgatgcacgatgacaagccatggtacaagagattcttgtaa

SEQ ID NO: 334 - protein, 555 aa, Candida glabrata
MSQSAISSTSATDPERQTPETKLEGEDFQLKADEASIQGAEIPRKPLGAYWTVMCLCLMIAFGGFVFGWDTGTISGFVAQTDFKRRFGQRHSDGTYYLSNVRTGLIVAIFNIGCAFGGLTLGRTGDLYGRKKGLVIVVSVYVVGIIIQIASVDKWYQYFIGRIISGLGVGGIAVLSPTLISETAPKHLRGTCVSFYQLMITLGIFLGYCTNYGTKNYSNSVQWRVPLGLCFAWALFMIGGMSMVPESPRFLVEKGRLEEARRSIAISNKLSMDDPGVTFELDTISAGVEAERLAGSASWGELFSNKGKILPRVIMGVMIQSLQQLTGNNYFFYYGTTIFKAVGLEDSFQTSIVLGIVNFASTFVGLWTVERFGRRRCLLWGSATMAACFVIFASVGVKSLYPHGRDHASSKGAGNCMIVFTCFFIFCFATTWAPIAYVIVSETYPLRVKNRAMAIAVGSNWIWGFLIGFFTPFITSAINFSYGYVFMGCLVFSYFYVFFFVCETKGLTLEEVNDMYEEGVLPWKSPNWVPPSRRDASYDIDAMMHDDKPWYKRFL

SEQ ID NO: 335 - DNA, 1695 bp, Candida glabrata
  CDS (1)..(1695)
atgtcacaagctcaaagtttgtcaccttctgaaagcgccgaaaactccccagtcagggaagtcaatgttgctaacagcttcaaagatgatgacttcattttggagcagaagcaaaccgctgatgtttctgcgatgtccccagaagcagaagcaccacctaaaccaatctcagcctactttactgtgatctgtctatgtttgatgatcgcattcggtggttttgtctttggctgggatactggtactatttctggttttgttgctcagaccgatttcaagagaagatttggacaacaagctgctgatggttcttactacttatctgatgtgagaactggtttgattgttgctattttcaatattggttgtgccattggtggtttgaccttgggtcgtcttggtgatatgtatggtcgtcgtcttggtttgatggctgttattactgtctacgttgttggtattgtaattcaaatctcttctaccactacctggtaccaatattttgttggtagaattgtctccggtcttggtgttggtggtattgctgtgctatccccaaccttaatttctgaaactgctccaaagcatttgagaggtacttgtgtgtcattctaccagttgatgattactttgggtatcttcttgggttactgtacaaactatggtaccaagactcacaccaattctattcaatggagagttcctctaggtctatgttttgcctgggctttgttcatgcttgttggtatgtccatggttcctgaatcaccaagattcttggttgagaagggtagatttgaagaggccagacgctctcttgcccgttctaacaaggtttccatggatgacccaattgtcacagctgaaattgaaaacatcagcgctggtgttgaagctgagaaatctgcaggtaatgcctcttggggtgaattgttttccaccaagggtaagatcttgcaacgtgttgtcatgggtatcatgatccaatctttgcaacaattgactggttgtaactacttcttctactacggtactactattttcaaggctgttggtttagaagattctttccaaacttctattatcttgggtattgtcaactttgcttccacctttgtcgctttgtatgttgttgaccgctttggtcgccgtaagtgtttgctatggggttcctctacaatggctgtctgcatggtcatctttgcttcagttggtgtcaagagtctatatcctaacggtaaggaccaaccatcctccactactgctggtaacgttatgattgttttcacctgtctatacatcttctgttttgcaactacttgggctccaactgcttacgttattgttgccgaaacctacccactacgtgttaaaaaccgtgctatggccattgctgttggtttcaactggatctggggtttcttgattggtttcttcacaccatttattactactgccattaacttctactacggttacgtcttcatgggctgtctagtcttctccttcttctacgtcttcttctttgtttgcgaaactaaaggtttgactttggaagaagtcaatgaaatgtacgaagaaggcgtcttgccatggaagtccgctcaatggctaccaactaccaagagaaccagtggctacgatgtggacgctgctttgcacgatgacaagccatggtacaagagatttgcttag

SEQ ID NO: 336 - protein, 564 aa, Candida glabrata
MSQAQSLSPSESAENSPVREVNVANSFKDDDFILEQKQTADVSAMSPEAEAPPKPISAYFTVICLCLMIAFGGFVFGWDTGTISGFVAQTDFKRRFGQQAADGSYYLSDVRTGLIVAIFNIGCAIGGLTLGRLGDMYGRRLGLMAVITVYVVGIVIQISSTTTWYQYFVGRIVSGLGVGGIAVLSPTLISETAPKHLRGTCVSFYQLMITLGIFLGYCTNYGTKTHTNSIQWRVPLGLCFAWALFMLVGMSMVPESPRFLVEKGRFEEARRSLARSNKVSMDDPIVTAEIENISAGVEAEKSAGNASWGELFSTKGKILQRVVMGIMIQSLQQLTGCNYFFYYGTTIFKAVGLEDSFQTSIILGIVNFASTFVALYVVDRFGRRKCLLWGSSTMAVCMVIFASVGVKSLYPNGKDQPSSTTAGNVMIVFTCLYIFCFATTWAPTAYVIVAETYPLRVKNRAMAIAVGFNWIWGFLIGFFTPFITTAINFYYGYVFMGCLVFSFFYVFFFVCETKGLTLEEVNEMYEEGVLPWKSAQWLPTTKRTSGYDVDAALHDDKPWYKRFA

SEQ ID NO: 337 - DNA, 1650 bp, Candida glabrata
  CDS (1)..(1650)
atgtctgaagaatcacaatctgcattctcagcttccaacagcaaagttgagagagaggaagacttcaaagcttacgctgatgaggatggtcaacccatggttgagattcccaaaaaaccagcttctgcttataccctcatctttatcctctgcttattcatcgctttcggggggttcgttttcggttgggatactggtactatttccggttttgttgctgaggaagacttcatcaaaagattgggtcaaagacgtgccaataacacttactacctatccaaggtcagaactggtctaattgtttctatatttaacattggttgtgctattggcggtgtcgtcttatccaagtttggagatatgtatggacgtaagatcggtttaattattgtcatcgttgtttatattgtcggtatcgtgattcaaattgctactattgacaagtggtaccaatacttcatcggtagaattgtttccggtctgggtgtcggtggtattgcggtattgtctcctatgttgatttccgaagtttctccaaaacatatgagaggtacattggtctcttgctaccagttaatggtgacttgcggtatcttcttgggttattgtaccaactacggtacaaaaaactaccccaactctgtacaatggagagttccactaggtctatgttttgcttgggctctattcatgataggtggtatgctgtgtgttccagaatctccacggtacttagttgaagtcggcaaatttgaagaagctagaagatccattgccatctctaacaaacttacaccagaagatccggcagtcactttcgagttagaaaatgttcaagcaggtgttgaagcagaaagattagctggttctgcttcctggggtgaattgttctctaccaagacgaaggtcttacaacgtttgattatgggcatcatgcttcaatgtttgcaacaattgacaggtgacaactacttcttctactatggtactactgttttcaaggctgttggcttggaagattctttccaaacttcaattgttattggtatcgttaactttgcatccacattcgtagctttgtacgttgttgaccgcttcggtcgtcgtaaatgtctcttgtggggagccgctagcatgactgcttgtatggttgtctttgcatcagttggtgtcaccagattatatccaaacggtatggaccaaccatcctccaagggtgctggtaactgtatgattgttttcacctgtttctacattttctgtttcgcaacaacttgggcaccaactccatgggtcatcaactccgaaacattcccattgagggttaaagccaagtgtatggcaatatgtcaagccgctaactggatctggggtttcttaattgccttcttcactccgttcatcacgggtgctatcaatttctactatggttacgtcttcatgggctgcctatgtttctcctacttctacgttttcttttttattccagaaacaaaaggcttaacattggaggaagtcaacactatgtgggaagaaggcgtcttgccatggaagtctccagattggattccaccatcaaagagagacgccacctatgatgctgatgccatgatgcacgatgataagccatggtaccggagaatgtggtaa

SEQ ID NO: 338 - protein, 549 aa, Candida glabrata
MSEESQSAFSASNSKVEREEDFKAYADEDGQPMVEIPKKPASAYTLIFILCLFIAFGGFVFGWDTGTISGFVAEEDFIKRLGQRRANNTYYLSKVRTGLIVSIFNIGCAIGGVVLSKFGDMYGRKIGLIIVIVVYIVGIVIQIATIDKWYQYFIGRIVSGLGVGGIAVLSPMLISEVSPKHMRGTLVSCYQLMVTCGIFLGYCTNYGTKNYPNSVQWRVPLGLCFAWALFMIGGMLCVPESPRYLVEVGKFEEARRSIAISNKLTPEDPAVTFELENVQAGVEAERLAGSASWGELFSTKTKVLQRLIMGIMLQCLQQLTGDNYFFYYGTTVFKAVGLEDSFQTSIVIGIVNFASTFVALYVVDRFGRRKCLLWGAASMTACMVVFASVGVTRLYPNGMDQPSSKGAGNCMIVFTCFYIFCFATTWAPTPWVINSETFPLRVKAKCMAICQAANWIWGFLIAFFTPFITGAINFYYGYVFMGCLCFSYFYVFFFIPETKGLTLEEVNTMWEEGVLPWKSPDWIPPSKRDATYDADAMMHDDKPWYRRMW

SEQ ID NO: 339 - DNA, 1602 bp, Candida glabrata
  CDS (1)..(1602)
atgatcagcggccctaaggaagaacttcaaaaggaggttgaagaagaactgcaccacaaaaagaagagtgacctaatatttgtctccttatgctgtattatggttgcctttggtggttttgtttttggctgggatacaggtactatttctggttttgttaaccaaacagattttctgagaagatttggacaacaaagaagtgatggtacctattacttgtctaatgttagaacaggtttaattgtcgctatctttaatatcggatgtgctattggtggtattaccctttcaaaacttggtgatatttggggaagaagattgggcttggttacggtcgtggttgtatatacaatcggcattgttatccaaatcgcctctattgataaatggtaccagtacttcatcggtagaattatctccggtttaggtgtcggtggtatcgctgtcttgtcaccaatgttaatctctgaggtttctccaaaacaattaagaggtacattagtttcttgctaccaactaatgattacatgtggtatctttttgggctactgtaccaattacggtacaaaaaactactccaactctgtccaatggagagttccattagggttatgtttcgcatgggcattatttatgatatttggtgttatgtgtgttcctgaatctccaagatatcttgtggaagtaggcaagttagaagaagccaagcgttctcttgccagagccaataaaacaactgtagattctccaatcgtccttttggaactggacaaatatcaagcatcagttgaagctgaacgtctggccggctctgcatcatggggagaattagtcacaggtaaaccacaaatgttaagacgtacaatcatgggtatgatgatccagtcgctacaacaattaacgggtgcaaactacttcttctactatggtactaccattttcagagctgttggattagatgattcattccaaactgcaattgttttaggtgttgtcaactttgtttcaacattctatgccttgtatactgtagaccactatggtcgccgtaattgtttaatgtggggttgtgttggtatggtatgttgttacgttgtctatgcctctgttggtgtaacgagactatggccaaatggtgagggtaacggctcttccaaaggtgctggtaactgtatgattgtttttgcatgtttctttattttctgttttgccactacatgggcaccaattgcctatgttattgtctctgagtcatacccactaagaattcgtggtaaggccatgtccatcgctattgctgctaactggatctggggtttcttgattgcttttttcactcctttcatcacatccgccattaatttctattacggatatgtcttcatgggctgtatggtatttgcatacttctacgtctttttctttgtccctgaaacaaaaggattaactctagaagaagttaatcaaatgtatgaagagggtgtacttccatggaagtcatccagttgggtgcctccagacagaagaactgccgagtacaatttggatgactattcccacgatgataagccatggtataagagagtattctcaagaaattga

SEQ ID NO: 340 - protein, 533 aa, Candida glabrata
MISGPKEELQKEVEEELHHKKKSDLIFVSLCCIMVAFGGFVFGWDTGTISGFVNQTDFLRRFGQQRSDGTYYLSNVRTGLIVAIFNIGCAIGGITLSKLGDIWGRRLGLVTVVVVYTIGIVIQIASIDKWYQYFIGRIISGLGVGGIAVLSPMLISEVSPKQLRGTLVSCYQLMITCGIFLGYCTNYGTKNYSNSVQWRVPLGLCFAWALFMIFGVMCVPESPRYLVEVGKLEEAKRSLARANKTTVDSPIVLLELDKYQASVEAERLAGSASWGELVTGKPQMLRRTIMGMMIQSLQQLTGANYFFYYGTTIFRAVGLDDSFQTAIVLGVVNFVSTFYALYTVDHYGRRNCLMWGCVGMVCCYVVYASVGVTRLWPNGEGNGSSKGAGNCMIVFACFFIFCFATTWAPIAYVIVSESYPLRIRGKAMSIAIAANWIWGFLIAFFTPFITSAINFYYGYVFMGCMVFAYFYVFFFVPETKGLTLEEVNQMYEEGVLPWKSSSWVPPDRRTAEYNLDDYSHDDKPWYKRVFSRN

(The sequence listing continues in the following parts.)

We claim:

1. A process for decreasing the amount of verbascose in a plant cell, plant, or part thereof, which comprises
   a) introducing into a chloroplast of a plant cell, plant, or a part thereof a nucleic acid comprising
      i) the nucleic acid sequence of SEQ ID NO: 71513;
      ii) a nucleic acid sequence encoding the amino acid sequence of SEQ ID NO: 71514;
      iii) a nucleic acid sequence encoding an amino acid sequence having at least 95% sequence identity to SEQ ID NO: 71514; or
      iv) a nucleic acid which hybridizes with the complement of the nucleic acid of (i) under high stringent hybridization conditions at about 0.2×SSC at 50° C. to 65° C.;
   b) introducing into a plant cell, plant, or a part thereof a nucleic acid operably linked to a polynucleotide encoding a transit peptide, wherein the nucleic acid comprises
      i) the nucleic acid sequence of SEQ ID NO: 71513;
      ii) a nucleic acid sequence encoding the amino acid sequence of SEQ ID NO: 71514;
      iii) a nucleic acid sequence encoding an amino acid sequence having at least 95% sequence identity to SEQ ID NO: 71514; or
      iv) a nucleic acid which hybridizes with the complement of the nucleic acid of (i) under high stringent hybridization conditions at about 0.2×SSC at 50° C. to 65° C.; or
   c) introducing into a plant cell, plant, or a part thereof a nucleic acid operably linked to a polynucleotide encoding a chloroplast localization sequence, wherein the nucleic acid comprises
      i) the nucleic acid sequence of SEQ ID NO: 71513;
      ii) a nucleic acid sequence encoding the amino acid sequence of SEQ ID NO: 71514;
      iii) a nucleic acid sequence encoding an amino acid sequence having at least 95% sequence identity to SEQ ID NO: 71514; or
      iv) a nucleic acid which hybridizes with the complement of the nucleic acid of (i) under high stringent hybridization conditions of about 0.2×SSC at 50° C. to 65° C.;
   wherein expression of the nucleic acid results in a decrease in the amount of verbascose relative to a corresponding control plant cell, plant, or part thereof.

2. The process of claim 1, wherein the transit peptide is derived from a protein selected from the group consisting of ribulose bisphosphate carboxylase/oxygenase, 5-enolpyruvyl-shikimate-3-phosphate synthase, acetolactate synthase, chloroplast ribosomal protein CS 17, Cs protein, ferredoxin, plastocyanin, ribulose bisphosphate carboxylase activase, tryptophan synthase, acyl carrier protein, plastid chaperonin-60, cytochrome $c_{552}$, 22-kDA heat shock protein, 33-kDa Oxygen-evolving enhancer protein 1, ATP synthase γ subunit, ATP synthase δ subunit, chlorophyll-a/b-binding proteinII-1, Oxygen-evolving enhancer protein 2, Oxygen-evolving enhancer protein 3, photosystem I: P21, photosystem I: P28, photosystem I: P30, photosystem I: P35, photosystem I: P37, glycerol-3-phosphate acyltransferases, chlorophyll a/b binding protein, CAB2 protein, hydroxymethyl-bilane synthase, pyruvate-orthophosphate dikinase, CAB3 protein, plastid ferritin, ferritin, early light-inducible protein, glutamate-1-semialdehyde aminotransferase, protochlorophyllide reductase, starch-granule-bound amylase synthase, light-harvesting chlorophyll a/b-binding protein of photosystem II, major pollen allergen Lol p 5a, plastid ClpB ATP-dependent protease, superoxide dismutase, ferredoxin NADP oxidoreductase, 28-kDa ribonucleoprotein, 31-kDa ribonucleoprotein, 33-kDa ribonucleoprotein, acetolactate synthase, ATP synthase $CF_0$ subunit 1, ATP synthase $CF_0$ subunit 2, ATP synthase $CF_0$ subunit 3, ATP synthase $CF_0$ subunit 4, cytochrome f, ADP-glucose pyrophosphorylase, glutamine synthase, glutamine synthase 2, carbonic anhydrase, GapA protein, heat-shock-protein hsp21, phosphate translocator, plastid ClpA ATP-dependent protease, plastid ribosomal protein CL24, plastid ribosomal protein CL9, plastid ribosomal protein PsCL18, plastid ribosomal protein PsCL25, DAHP synthase, starch phosphorylase, root acyl carrier protein II, betaine-aldehyde dehydrogenase, GapB protein, glutamine synthetase 2, phosphoribulokinase, nitrite reductase, ribosomal protein L12, ribosomal protein L13, ribosomal protein L21, ribosomal protein L35, ribosomal protein L40, triose phosphate-3-phosphoglycerate-phosphate translocator, ferredoxin-dependent glutamate synthase, glyceraldehyde-3-phosphate dehydrogenase, NADP-dependent malic enzyme, and NADP-malate dehydrogenase.

3. A process for producing a plant cell, plant or part thereof with a decrease in the amount of verbascose relative to a corresponding control plant cell, plant or part thereof, which comprises
   a) introducing into a chloroplast of a plant cell, plant, or a part thereof a nucleic acid comprising
      i) the nucleic acid sequence of SEQ ID NO: 71513;
      ii) a nucleic acid sequence encoding the amino acid sequence of SEQ ID NO: 71514;
      iii) a nucleic acid sequence encoding an amino acid sequence having at least 95% sequence identity to SEQ ID NO: 71514; or
      iv) a nucleic acid which hybridizes with the complement of the nucleic acid of (i) under high stringent hybridization conditions of about 0.2×SSC at 50° C. to 65° C.;

b) introducing into a plant cell, plant, or a part thereof a nucleic acid comprising a nucleic acid operably linked to a polynucleotide encoding a transit peptide, wherein the nucleic acid comprises
  i) the nucleic acid sequence of SEQ ID NO: 71513;
  ii) a nucleic acid sequence encoding the amino acid sequence of SEQ ID NO: 71514;
  iii) a nucleic acid sequence encoding an amino acid sequence having at least 95% sequence identity to SEQ ID NO: 71514; or
  iv) a nucleic acid which hybridizes with the complement of the nucleic acid of (i) under high stringent hybridization conditions of about 0.2×SSC at 50° C. to 65° C.; or
c) introducing into a plant cell, plant, or a part thereof a nucleic acid operably linked to a polynucleotide encoding a chloroplast localization sequence, wherein the nucleic acid comprises
  i) the nucleic acid sequence of SEQ ID NO: 71513;
  ii) a nucleic acid sequence encoding the amino acid sequence of SEQ ID NO: 71514;
  iii) a nucleic acid sequence encoding an amino acid sequence having at least 95% sequence identity to SEQ ID NO: 71514; or
  iv) a nucleic acid which hybridizes with the complement of the nucleic acid of (i) under high stringent hybridization conditions of about 0.2×SSC at 50° C. to 65° C.;
wherein expression of the nucleic acid results in a decrease in the amount of verbascose relative to a corresponding control plant cell, plant or part thereof.

4. The process of claim 3, further comprising regenerating a plant from the plant cell.

5. An expression cassette comprising a promoter that functions in plants operably linked to a nucleic acid encoding a fusion protein, wherein the fusion protein comprises a chloroplast transit peptide and a polypeptide comprising
  i) an amino acid sequence having at least 95% sequence identity to the amino acid sequence of SEQ ID NO: 71514;
  ii) the amino acid sequence of SEQ ID NO: 71514; or
  iii) an amino acid sequence encoded by a nucleic acid molecule which hybridizes under high stringent hybridization conditions of about 0.2×SSC at 50° C. to 65° C. with the complement of a nucleic acid molecule comprising the sequence of SEQ ID NO: 71513;
wherein the expression cassette when expressed in a plant cell, plant, or part thereof results in a decrease in the amount of verbascose relative to a corresponding control plant cell, plant, or part thereof.

6. The expression cassette of claim 5, wherein the polypeptide comprises an amino acid sequence having at least 95% sequence identity to the amino acid sequence of SEQ ID NO: 71514.

7. The expression cassette of claim 5, wherein the polypeptide comprises the amino acid sequence of SEQ ID NO: 71514.

8. A vector comprising the expression cassette of claim 5.

9. A plant cell, plant or part thereof comprising the expression cassette of claim 6.

10. A food or feed composition comprising the plant or part thereof of claim 9.

11. A transgenic plant or part thereof obtained by the method of claim 3.

12. A plant cell obtained by the method of claim 3.

13. A transgenic seed obtained from the plant of claim 9, wherein said transgenic seed comprises said expression cassette.

14. The process of claim 1, further comprising regenerating a plant from the plant cell.

15. A plant cell, plant or part thereof comprising the expression cassette of claim 5.

16. A food or feed composition comprising the plant or part thereof of claim 15.

17. A transgenic plant cell, plant, or part thereof obtained by the method of claim 2.

18. A plant cell, plant, or part thereof obtained by the method of claim 1.

19. A transgenic seed obtained from the plant of claim 15, wherein said transgenic seed comprises said expression cassette.

20. A process for producing a polypeptide in a plant cell, plant, or part thereof, comprising:
  (a) obtaining a plant cell, plant, or part thereof transformed stably or transiently with a nucleic acid molecule; and
  (b) producing a polypeptide encoded by said nucleic acid molecule in said plant cell, plant, or part thereof,
  wherein said polypeptide is expressed in, or targeted to, a chloroplast of said plant cell, plant, or part thereof,
  wherein said nucleic acid molecule is:
  (i) a nucleic acid molecule encoding a polypeptide comprising the amino acid sequence of SEQ ID NO: 71514;
  (ii) a nucleic acid molecule comprising the nucleic acid molecule of SEQ ID NO: 71513;
  (iii) a nucleic acid molecule encoding a polypeptide having at least 95% sequence identity to the amino acid sequence of SEQ ID NO: 71514; or
  (iv) a nucleic acid molecule which hybridizes with the complement of the nucleic acid molecule of (ii) under high stringent hybridization conditions of about 0.2× SSC at 50° C. to 65° C.,
  and wherein expression of said nucleic acid molecule in said plant cell, plant, or part thereof confers a decrease in the amount of verbascose relative to a corresponding control plant cell, plant, or part thereof.

21. The process of claim 20, wherein said plant cell, plant, or part thereof is transformed stably or transiently with a nucleic acid construct comprising said nucleic acid molecule.

22. The process of claim 20, wherein said plant cell, plant, or part thereof is transformed stably or transiently with a vector comprising said nucleic acid molecule.

* * * * *